(12) United States Patent
Oriedo et al.

(10) Patent No.: US 7,291,767 B2
(45) Date of Patent: Nov. 6, 2007

(54) NUCLEIC ACIDS COMPOSITIONS CONFERRING DWARFING PHENOTYPE

(75) Inventors: J. Vincent B. Oriedo, Midland, MI (US); David McCrery, Lake Jackson, TX (US); Philip Savickas, Franklin, MA (US); Barbara A. Miller, Midland, MI (US); Randy Pell, Midland, MI (US); Ignacio M. Larrinua, Indianapolis, IN (US); Ted Weglarz, Fishers, IN (US); Daniel Gachotte, Indianapolis, IN (US); Avutu S. Reddy, Carmel, IN (US); Max Ruegger, Indianapolis, IN (US); Beth Blakeslee, Indianapolis, IN (US); Gregory P. Pogue, Vacaville, CA (US); Rodney Crosley, Indianapolis, IN (US); Wenjin Zheng, Vacaville, CA (US); Guy R. Della-Cioppa, Vacaville, CA (US); Gerson Wolfe, Davis, CA (US)

(73) Assignee: The Dow Chemical Company, Midland, MI (US)

( * ) Notice: Subject to any disclaimer, the term of this patent is extended or adjusted under 35 U.S.C. 154(b) by 220 days.

(21) Appl. No.: 10/333,184

(22) PCT Filed: Jul. 20, 2001

(86) PCT No.: PCT/US01/23120

§ 371 (c)(1),
(2), (4) Date: Oct. 10, 2003

(87) PCT Pub. No.: WO02/08410

PCT Pub. Date: Jan. 31, 2002

(65) Prior Publication Data

US 2004/0088762 A1    May 6, 2004

Related U.S. Application Data

(60) Provisional application No. 60/219,809, filed on Jul. 20, 2000, provisional application No. 60/219,810, filed on Jul. 20, 2000.

(51) Int. Cl.
C12N 15/29     (2006.01)
C12N 15/82     (2006.01)
A01H 5/00      (2006.01)

(52) U.S. Cl. .................. 800/298; 536/23.6; 435/320.1
(58) Field of Classification Search .............. 536/23.1, 536/23.6; 435/320.1, 468; 800/298, 278, 800/287
See application file for complete search history.

(56) References Cited

OTHER PUBLICATIONS

Larkin et al (1994, The Plant Cell 6:1065-1076).*
Kano-Murakami et al (1993, FEBS 334:365-368).*
Fourgoux-Nicol et al (1999, Plant Molecular Biology 40 :857-872).*
Bowie et al, Science 247:1306-1310, 1990.*
McConnell et al, Nature 411 (6838):709-713, 2001.*
Merkle et al (1994, The Plant Journal 6(4):555-565).*

* cited by examiner

*Primary Examiner*—Stuart F. Baum
(74) *Attorney, Agent, or Firm*—Medlen & Carroll, LLP

(57) ABSTRACT

This invention relates to putative known and unknown deoxyribonucleic acid (DNA) and amino acid sequences identified in one or more metabolic pathways that lead to dwarfism and stunting in plants and the use of these sequences in agriculture to create dwarf varieties of any plant species. This invention also relates to nucleic acids sequences and polypeptides that produce altered metabolism phenotypes in plants.

7 Claims, 255 Drawing Sheets

Figure 1a

>SEQ ID NO:1  20012_300163_1   *Nicotiana bentamiana*, antisense
AGCAATCTTAACTCCGCCTTCTACCTCGATCTCCCAACAGAGGCAACCCT
TGCCCAACTTCTCTGAAACACGCATCACCATTGCACCTCTCTGCTCTCCG
TACTCACTTGGGCAGTATGAGAAGCAATATGTTTACGGGGTTCACGAGGC
TTTGCAAGGGTCTTGCGGTTGTGCTTGTGGGCGGTCACATTGTTGTCCAG
ATTCTTCCTTCTGCTCTTTCCTATCTTGCTCTCATCCCTGTCAAGATGAG
GACGTTGCATGGAGCTGGAGGGATGGATTTCTCCCACCTGATGATCATCA
TCTTTAATATTCTCAATTTGTCTACGAGGAGAGGATGATATTTCATTAGC
CCAGCCTTCATTTTCCGCATTGGATATTCGACTCTCCTCATTACTATATT
GCGGGTAACTGCATAATAAGTGAACCGGGGAGGTACCATGCAACGGTGTG
GCCGGTCTGCTAGAGACAGGGGTGTTGTTTCCCGATAGCCGGCCGTGTTT
CACCCGCTTTTTCGCTGTGTTGTGCCAGCTTCTAAGAGCTGTTGCCACAT
TATCACCAAAGATTATAGGTTTCATTGATGTTCCCATCTGCAAATTTCAC
CAAATCTCTCAGCACTAATTTATCTTTATAAGAGTTTTTGTTGTGAAAAG
GGAAGACTAGTTTAGTTATAGAGTACCTGTGTGACCAAGGCATAAAGAGG
GAGAGTCACATAGCTGCAATGGACCTGTATGATCACCCTGAAACAAGAAA
CAAAAACTATCAATATAGAAGGAATTAAAATATGCATCTTTAATTGTTCG
AACAAAAAAAAAAAAAAA
> SEQ ID NO:2  20023_300163_1   *Nicotiana bentamiana*, antisense
TGCTGATTTTGGGTATACAACTGAAATGTTTGAGAAGGACATGGAGCTTT
GGCAACGAAGGGTTGAACATTACTGGAATCTTTTAAGTCCAAAGATCTCT
TCAGACAGTCTGAGAAACATCATGGATATGAAGGCCAATTTGGGGTCATT
TGCTGCTGCTTTGAAGGACAAAGATGTTTGGGTCATGAATGTTGTATCCA
AAGATGGACCTAACACTCTCAAGATTGTATATGACCGTGGTTTGATCGGC
ACAACTCATGACTGGTGTGAAGCATTTTCGACATATCCTAGGACCTATGA
TTTGGTCCATGCGTGGAGTGTTTTCTCTGACATTGAAAAGAAAGGTTGCA
GCGGTGAGGATCTGTTACTCGAGATAGATCGCATACTAAGGCCTAGTGGT
TTTGTTATCTTCAACGACAAACAACATGTTATTGACTTTGTAAAGAAGTA
TTTATCGGCATTGCACTGGGAAGCAGTAGCTGATCCAACTTCAGATCCAG
ACCAAGAAGGAGATGACATTGTTTTTATCATCCAAAAGAAAATGTGGCTG
ACAAGTGAAAGCATCAGAGATACAGAGTAAATAAAGTTTGCCACTAAGTA
CACTTCTTGATTCATTTTCCCCTTCCTTTTGGGATTAAGAAATACACACC
CCTAAAGGTTTGGGAGATATCAGTTTGATTTTGTAGTATTTATGATATTT
ATTTCTTCCTTTTCTTCATTAACTTAATTTCAACTTGTTGTTTCTTTTAA
TTGATAAACAAACTCATAGACTATATATGCATTTATAGGCTATTCTCGAA
AAAAAAAAAAAAA
> SEQ ID NO:3  21604_300070_1 *Arabidopsis thaliana*, sense
GAAGCACGAACGGCGTCGGGTTAGTCCGACGGAGGAACCATGTCCTCGTC
TCTTCTTCTCTCCGGTTCTACTGTATCTTCTTCGTTTATCGCTCCATCTA
AGCCTTCTCTCGTACGAAATTCCAGTAAGACATCACTGTTACCATTTCGT
AATGTTTCGAGAAGCTTCAAAACCGTCAAGTGCACCGTTGATTCTTCATA
TGGAGGCAATGTTCCCACGTTCCCTCGGACGAGAGTTTGGGACCCGTACA
AACGTCTAGGAGTTAGTCCATATGCTTCCGAGGAAGAAATCTGGGCCTCT
CGTAACTTTCTTTTACAGCAGTACGCTGGACATGAAAGAAGCGAAGAGTC
TATAGAAGGAGCCTTTGAGAAGCTTCTCATGTCTAGTTTTATCAGAAGGA
AGAAGACTAAAATCAATCTTAAATCAAAGTTGAAGAAGAAAGTTGAGGAA
TCTCCTCCGTGGCTCAAAGCTCTTCTCGATTTCGTTGAAATGCCTCCCAT
GGACACTATTTTCAGAAGACTTTTCCTCTTTGCCTTCATGGGTGGTTGGA
GTATCATGAACTCTGCAGAAGGCGGTCCTGCGTTTCAGGTGGCGGTATCA
TTGGCTGCGTGCGTATATTTTCTGAATGAGAAGACAAAGAGCTTGGGGAG
AGCTTGCTTAATCGGAATTGGAGCTTTAGTTGCCGGGTGGTTCTGCGGTT
CGTTAATCATTCCCATGATTCCGACGTTTCTCATTCAGCCTACATGGACA
CTCGAGCTCCTAACATCACTGGTCGCTTATGTGTTTTTGTTTCTTTCTTG
TACTTTCCTCAAGTAAGTTACGTTGTGGTTTTATCCAAACTCTTTTTGTT
CTTTTCGCCCAGACATTTACAGAACCTTTCGGAAAAATTAGTGAAAGTTG
TTAAGTGAAAAAAAAAAAAAAAGGGCGGCCGCACCCTAGGCCAGT
> SEQ ID NO:4  21627_300070_1 *Arabidopsis thaliana*, sense
GAAGCACGAACGGCGTCGGGTTAGTCCGACGGAGGAACCATGTCCTCGTC

Figure 1b

```
TCTTCTTCTCTCCGGTTCTACTGTATCTTCTTCGTTTATCGCTCCATCTA
AGCCTTCTCTCGTACGAAATTCCAGTAAGACATCACTGTTACCATTTCGT
AATGTTTCGAGAAGCTTCAAAACCGTCAAGTGCACCGTTGATTCTTCATA
TGGAGGCAATGTTCCCACGTTCCCTCGGACGAGAGTTTGGGACCCGTACA
AACGTCTAGGAGTTAGTCCATATGCTTCCGAGGAAGAAATCTGGGCCTCT
CGTAACTTTCTTTTACAGCAGTACGCTGGACATGAAAGAAGCGAAGAGTC
TATAGAAGGAGCCTTTGAGAAGCTTCTCATGTCTAGTTTTATCAGAAGGA
AGAAGACTAAAATCAATCTTAAATCAAAGTTGAAGAAGAAAGTTGAGGAA
TCTCCTCCGTGGCTCAAAGCTCTTCTCGATTTCGTTGAAATGCCTCCCAT
GGACACTATTTTCAGAAGACTTTTCCTCTTTGCCTTCATGGGTGGTTGGA
GTATCATGAACTCTGCAGAAGGCGGTCCTGCGTTTCAGGTGGCGGTATCA
TTGGCTGCGTGCGTATATTTTCTGAATGAGAAGACAAAGAGCTTGGGGAG
AGCTTGCTTAATCGGAATTGGAGCTTTAGTTGCCGGGTGGTTCTGCGGTT
CGTTAATCATTCCCATGATTCCGACGTTTCTCATTCAGCCTACATGGACA
CTCGAGCTCCTAACATCACTGGTCGCTTATGTGTTTTGTTTCTTTCTTG
TACTTTCCTCAAGTAAGTTACGTTGTGGTTTTATCCAAACTCTTTTTGTT
CTTTTCGCCCAGACATTTACAGAACCTTTCGGAAAAATTAGTGAAAGTTG
TTAAGTGAAAAAAAAAAAAAAAGGGCGGCCGCACCCTAGGCCAGT
    > SEQ ID NO:5  23730_300071_1  Arabidopsis thaliana, sense
AAAGGATTTGCTCTGAGGGCTGGGCTCGGGGGTCCCAGTTCCGAACCCGT
CGGCTGTCAGCGGACTGCTCGAGCTGCTTCCGCGGCGAGAGCGGGTCGCC
GCGTGCCGGCCGGGGGACGGACTGGGAACGGCTCTCTCGGGAGCTTTCCC
CGGGCGTCGAACAGTCAGCTCAGAACTGGTACGGACAAGGGGAATCCGAC
TGTTTAATTAAAACAAAGCATTGCGATGGTCCCTGCGGATGCTAACGCAA
TGTGATTTCTGCCCAGTGCTCTGAATGTCAAAGTGAAGAAATTCAACCAA
GCGCGGGTAAACGGCGGGAGTAACTATGACTCTCTTAAGGTAGCCAAATG
CCTCGTCATCTAATTAGTGACGCGCATGAATGGATTAACGAGATTCCCAC
TGTCCCTGTCTACTATCCAGCGAAACCACAGCCAAGGGAACGGGCTTGGC
AGAATCAGCGGGGAAAGAAGACCCTGTTGAGCTTGACTCTAGTCCGACTT
TGTGAAATGACTTGAGAGGTGTAGGATAAGTGGGAGCTTCGGCGCAAGTG
AAATACCACTACTTTTAACGTTATTTTACTTACTCCGTGAATCGGAGGCG
GGGTACAACCCCTGTTTTGGTCCCAAGGCTCGCTTCGGCGGGTCGATCC
GGGCGGAGGACATTGTCAGGTGGGGAGTTTGGCTGGGCGGCACATCTGT
TAAAAGATAACGCAGGTGTCCTAAGATGAGCTCAACGAGAACAGAAATCT
CGTGTGGAACAAAATACCACTACTTTTAACGTTATTTTACTTACTCCGTG
AATCGGAGGCGGGGTACAACCCCTGTTTTGGTCCCAAGGCTCGCTTCGG
CGGGTCGATCCGGGCGGAGGACATTGTCAGGTGGGGAGTTTGGCTGGGG
    > SEQ ID NO:6  25004_300072_1  Arabidopsis thaliana, antisense
TGACTGATTACTACTACTTGTACTAACTCTAATACATTTACAAAACAAGT
CCTCCTTTTCCCCAAGTATACAGATAAAGATTTACCAGAACCGGTTTTCC
GCCTTCATCTCACATGGAAATCGTAAGGAGAAGACGCATACACTTGATCT
GGAACCACTAGTGGTAACTTCTCAATGTACATAAACAATCGTTTCTGGTT
CTCTCTAGCGATTGCAGTGAGATTCACTGTATCGTTTTGGTCCAAAAACA
TCCAGAGATCACCTGAATCTACTCTTTTAAGGCTGTCT
    > SEQ ID NO:7  25008_300072_1  Arabidopsis thaliana, antisense
ACCTCCAGCCCTGATGATGGTGTATGGAATACCGGAATCAGCCAAGTATT
GCTCAGCCTTTCTCTTCCAGACCAGAATGTTAGCATTGCCAATACTATTG
AGAGGGTGATTAATGTTTGTTCCTCCCATCGACCCAACCAAAACAATCTG
CTTAACTCCTGCAGAGACAGCCTTAAAAGAGTAGATTCAGGTGATCTCTG
GATGTTTTGGACCAAAACGATACAGTGAATCTCACTGCAATCGCTAGAG
AGAACCAGAAACGATTGTTTATGTACATTGAGAAGTTACCACTAGTGGTT
CCAGATCAAGTGTATGCGTCTTCTCCTTACGATTTCCATGTGAGATGAAG
GCGGAAAACCGGTTCTGGTAAATCTTTATCTGTATACTTGGGGAAAAGGA
GGACTTGTTTTGTAAATGTATTAGAGTTAGTACAAGTAGTAGTAATCAGT
CA
    > SEQ ID NO:8  25009_300072_1  Arabidopsis thaliana, antisense
AAAAGCCCTCCATGTCCCACCAGGACTTGCACCATCAAAATGGGATACTT
GCAGTGATGTCGTGAGTGAACACTGGAATGACTCTCCTTCCTCGGTTCTA
```

Figure 1c

```
AACATTTACCACGAGCTTATAGCTGCTGGGCTTCGTATCTGGGTTTTCAG
TGGGGACGCAGATGCCGTTGTACCAGTCACATCAACCCGGTACAGTATCG
ATGCACTAAACCTTCGTCCTTTGAGTGCCTATGGTCCTTGGTACTTAGAT
GGACAGGTGGGAGGGTGGAGTCAGCAGTATGCTGGTCTGAACTTTGTGAC
AGTGAGAGGTGCAGGCCATGAAGTTCCTTTGCACAGACCGAAGCAAGCTC
TTGCGCTCTTCAAGGCTTTTATATCTGGAACTCCATTGTCCACACATGAG
AACAGCATCAGCCGCGACATGTCTGAACTCGTTAGTGACTCATAATGAGT
TCTGATTTGATGTAATGTGTGATTTGGATTCTCAATCAAAAACTTTCCAC
ATAGGCCGTTGAAATAAGAAGAGGGAAAGAGAATAAATCAGTGTTTTAAG
TG

> SEQ ID NO:9  25011_300072_1  Arabidopsis thaliana, antisense
TTTTGAATGAATAAAAGTCTTATAATTATGATGTGTGTACAACTACAAAG
TTTTCCTTGGAGTATAGTTTGAGGATTTATCCAGAAGTAGCAGAAGAAGC
AGCTACAGACTCGGAGAGTTCTTCCATGAGTTCCTTTTGCTCCAAAGCAG
CACAAGCCTGCACTGCGTCCTCTAAAGCACCGTCAAGAAATGTTGTAAGC
GCAAAGTTCATCTTTAGCCTATGATCAGTCACTCTACTGTCCTTATAATT
GTATGTTCTTATCTTTTCTGAACGAGCTCCAGTCCCAACCTGAGATTTCC
TTTCATTCCTTATCTTCTCTTGTTGTTCCCTTACTTTTATTTCATACAGT
TTTGCTCGCAGAAGCTGGAAAGCACGCGCCTTATTCCTAAT
> SEQ ID NO:10  25015_300072_1  Arabidopsis thaliana, antisense
CTGCAGCTGTGTGCTCCTTAGCTAAGGTGGCAATGGCAGACGATGAGCCA
AAGAGAGGAACAGAAGCTGCCAAGAAGAAGTATGCTCCAGTCTGTGTCAC
AATGCCTACCGCCAAGATATGCCGTAACTGAGTTTGCTATTTAACCAGCA
ACTGTATCTATGTCGATAACTATTCTCAGTGTGGTTTGTAAGGATCATA
> SEQ ID NO:11  25016_300072_1  Arabidopsis thaliana, antisense
TGGTTCTCTGAGATTAGTCCTATGTGGCCAGGAGAAGCACATTCTCTCAA
GGTAGAGAAGATTCTATTCCAAGGGAAATCAGATTACCAGGATGTTATTG
TTTTCCAGTCTGCAACATATGGAAAGGTTTTGGTTTTGGATGGAGTGATT
CAACTCACTGAGAGAGATGAATGTGCGTATCAAGAAATGATCACTCATCT
TCCTTTGTGCTCTATCTCCAACCCCAAAAAGGTACTGGTGATTGGAGGAG
GAGATGGAGGAGTCCTGAGGGAAGTGGCACGTCATAGTTCTGTTGAGCAG
ATTGACATTTGTGAAATAGATAAAATGGTGGTTGATGTGGCTAAGCAGTA
TTTCCCTAATGTAGCAGTTGGATACGAGGATCCTCGTGTCAACCTCATCA
TTGGCGATGGTGTTGCTTTCTTGAAGAACGCTGCTGAAGGAACCTATGAT
GCAGTTATTGTTGATTCATCTGATCCAATCGGTCCAGCAAAAGAGCTATT
TGAGAAACCTTTCTTTGAGTCAGTGAATAGAGCTCTTCGTCCTGGTGGAG
TTGTGTGCACACAAGCTGAAAGCTTGTGGCTTCACATGGATATCATTGAA
GACATTGTTTCTAATTGCCGTGACATCTTTAAAGGATCTGTTAACTACGC
TTGGACCAGTGTTCCAACTTACCCGAGTGGAGTCATTGGATTCATGCTTT
GTTCATCTGAAGGACCACAAGTCGATTTCAAGAAGCCAGTGAGTCTAATC
GATACTGATGAAAGCTCTATCAAATCACACTGTCCCTTGAAGTATTACAA
CGCTGAGATTCACTCAGCTGCTTTCTGCTTGCCCTCTTTTGCTAAGAAGG
TGATTGATTCGAAAGCCAACTAGAAAAGAGAAGAGAAATCATTTGCTTTA
GAGAAACTTCATGTGGAAGTGATAATATGATGATACAATGATCCTTTGGA
AAAAAATAAAGAAGTTTTAATTTTAGAATGTAATGTTCTTTCACCTGCA
ATGTTATGTGACTGCACTGAGCTATCAATCTCTTTTTATAAGCATTACAC
ATATTTCAAAAAA
> SEQ ID NO:12  25018_300072_1  Arabidopsis thaliana, antisense
AAATCCCCAAATTTTCAACAAGGATAAGAGCCGGAAGCTCATCGCCGGTG
AACGGAACTAGGGTTTCATTCATCCCCAAATTGATAACAAGAAAATGGCT
CATGCTTGCGTCTCTACATCGGCTTCTTCTCTCAGATTCACAGCTGGATT
CGTCTCCGCTAGTCCCAATGGCTCCTCTTTCGATTCTCCCAAGCTTTCTC
TTCCTTTCGAGCCTCTCCGTTCAAGGAAGACGAATAAGTTAGTTAGCGAT
AGAAAGAATTGGAAGAATTCAACTCCGAAAGCTGTATATTCCGGCAATCT
CTGGACACCGGAGATTCCGTCTCCTCAAGGAGTTTGGTCCATTAGAGATG
ATTTACAAGTCCCTTCTTCGCCGTATTTTCCTGCTTATGCTCAAGGACAA
GGACCACCTCCTATGGTGCAAGAACGTTTCCAGAGTATCATTAGTCAGCT
```

Figure 1d

```
CTTCCAATATAGGATTATTCGCTGTGGTGGTGCTGTGGATGACGATATGG
CAAACATAATTGTAGCTCAACTCCTGTATCTTGATGCTGTTGATCCTACT
AAGGATATTGTCATGTATGTTAATTCTCCTGGTGGATCAGTTACAGCTGG
CATGGCTATATTCGATACTATGAGGCACATCCGGCCTGATGTGTCCACTG
TTTGTGTTGGTCTAGCTGCTAGTATGGGAGCTTTTCTGCTTAGTGCTGGA
ACCAAAGGAAAAAGATACAGTCTACCAAACTCAAGGATAATGATCCATCA
GCCGCTTGGTGGAGCTCAAGGTGGCCAAACCGACATTGACATTCAGGCAA
ATGAAATGCTGCATCACAAGGCAAACCTAAACGGTTACCTCGCATACCAC
ACTGGTCAAAGCCTGGAGAAGATAAACCAGGACACAGACCGTGATTTCTT
CATGAGTGCCAAAGAAGCAAAAGAGTATGGACTTATCGACGGTGTTATCA
TGAACCCTCTTAAAGCTCTCCAGCCACTTGCAGCAGCTTAATCGCCTAAA
GGTAGTGGTTCAGCTTTAGCACTTGTTCTTTTTTGGGCCTTTGATGAACT
GAGATTTTCCATGAAATATGTTTCTATTCTACAAGGAAAATCAGATTTGT
TTGGGATCAAACTCTGTAGTTGATACATACATGAAGACCAAAGTAAAGTT
TCTTACTGTGCTGAAAAAAAAAA
> SEQ ID NO:13 25024_300072_1  Arabidopsis thaliana, antisense
AGAAACGATGAGTTCTCAGATTTCGGAGATTGAACAAGAGCAGCTGATCG
AGAAGCTTGAGATCTTCAAGATCCATGGCAGAGACAAACGTGGCCGTAAG
ATCCTTCGTATTATCGGAAAATTCTTCCCAGCTCGATTTCTGTCACTGGA
TGTGTTGAAGAAGTATCTAGAGGAGAAGATATTTCCTCGATTAGGTAGAA
AACCATTCGCCGTACTCTACGTCCACACCGGCGTACAGAGAAGCGAGAAC
TTCCCAGGTATCTCAGCTCTACGAGCGATCTACGACGCAATTCCGGTAAA
CGTCAGAGACAATCTTCAGGAGGTTTACTTCCTCCATCCAGGTCTTCAAT
CACGTCTCTTCCTCGCCACCTGCGGCCGATTTCTATTTTCCGGCGGGTTG
TACGGGAAGCTGAGGTACATAAGCAGAGTTGATTATCTGTGGGAACATGT
GAGGAGGAATGAGATAGAGATGCCGGAGTTTGTATACGATCACGATGATG
ATCTGGAGTATCGTCCGATGATGGATTACGGTCAAGAAAGCGATCACGCG
AGGGTTTTCGCCGGAGCCGCCGTGGATTCATCAGTCTCAAGTTTCTCCAT
GAGGTGTATCTCATAGCGTAAAAGGCTAAAACTCCACCCACTAGATATCG
GATCGTATCTTATAAACCATATAATATACGAATACGATTAATAATATATC
AAAAAGATTGGAAATAGGTGTGCTTTTTGAAATTAGTGAGCGTTTTTTAT
GGAAAAGAAAAGAAAAGAAAGCAGTTGGCGTCTGGATAAAGGGAAGGAGG
AGAATCTTTAGATTTTTTCTTTAATCTGTTTTTCTTTTGTCTTGATTAGT
TTTTTCTTTAGTGGTGGTGGTTGTGAGTTAGTGTGTAAAATGTATATTGT
CATATGTGAATTTAATAATAAGTCCTTTTGTAAGATGATCAAGGGAAAAA
AAAAAAAAA
> SEQ ID NO:14 25026_300072_1  Arabidopsis thaliana, antisense
GCAGCACTTGTCTGACCCATGGCACAACACTATTGTCCAAACCTTCAACT
AAAGAGTGAAGACAGACTTATGATCTCATACCTATCTATCTTCCATCACT
TTCATGTCTGTCTGTGAGTGTGTTTCATCTTAGAGTTCTTGGTTTTTGAG
CTTGAATTATTGTTGAACCGTTGTAGCTCCATGAACAAATTTGGAATCTT
CAATGTACAGAGGAACTAAGTTAATCAACATTGTTGTACTCTTTAAAAAA
> SEQ ID NO:15 25027_300072_1  Arabidopsis thaliana, antisense
TTTTGAATGAATAAAAGTCTTATAATTATGATGTGTGTACAACTACAAAG
TTTTCCTTGGAGTATAGTTTGAGGATTTATCCAGAAGTAGCAGAAGAAGC
AGCTACAGACTCGGAGAGTTCTTCCATGAGTTCCTTTTGCTCCAAAGCAG
CACAAGCCTGCACTGCGTCCTCTAAAGCACCGTCAAGAAATGTTGTAAGC
GCAAAGTTCATCTTTAGCCTATGATCAGTCACTCTACTGTCCTTATAATT
GTATGTTCTTATCTTTTCTGAACGAGCTCCAGTCCCAACCTGAGATTTCC
TTTCATTCCTTATCTTCTCTTGTTGTTCCCTTACTTTTATTTCATACAGT
TTTGCTCGCAGAAGCTGGAAAGCACGCGCCTTATTCCTAAT
> SEQ ID NO:16 25032_300074_1  Arabidopsis thaliana, antisense
AGAACTAGTCAGTTTCTTTGTTTTAGACAACAAGAATCTGTGAACTAACA
CAAAAACATTGAAAGAATGATCTTAACAATGAAACTTGTTCACCCTCTCC
ATCACTCTTTGTCTTCCTCCATTCCCTTTCCCTCAAGAAAAAGGCAATCC
AAACCGTACCGGTGCTCGTTACCTTCTCCGGCTGCGAAAAGGTCATCAG
AACAGAGACTGTCCTGCCTCCGGCGCCGGTGAGTTGTGAAGGGAGAAGGG
TCTTACTTGGATGTCTTCTCGCTACAGCTTCTGGGATTTTGTCAACTGGT
```

Figure 1e

```
TCAGCCGAGGCAGTAAGCACCAGTAGAAGAGCTCTACGTGCATCCAAGTT
ACCGGAAAGCGATTTCACGACTCTCCCCAATGGTCTCAAGTACTATGATA
TAAAGGTTGGCAATGGAGCAGAGGCTGTGAAAGGATCTCGGGTCGCAGTT
CACTATGTTGCAAAATGGAAAGGGATAACGTTCATGACAAGTCGACAAGG
ACTTGGTGTTGGAGGTGGAACGCCTTATGGGTTTGACGTTGGTCAATCAG
AGAGAGGCAATGTTCTGAAAGGACTTGATCTTGGTGTTGAAGGGATGCGT
GTAGGCGGTCAGAGATTGGTGATTGTTCCTCCCGAGCTGGCTTACGGGAA
GAAAGGAGTGCAAGAGATTCCTCCAAACGCTACGATAGAGCTTGACATTG
AGCTGTTATCAATCAAGCAGAGTCCTTTCGGGACGCCAGTGAAGATAGTT
GAAGGCTAAAAGGACTAATGAAGCCAACATTGTACCAAGATTTTCTGTGT
ACATTCAGTAAAAAACTATAAAATTGATCAAAGCTATGGAAGATTCAACT
GTATGAGAAGAATCTGTTTAATGGATTATACCGGCTAGTCCGGTTTTGTA
ACCGCTTTATAACTGTGTCTCATCACTCAATTCATACACTTTTGGCCGTT
TTGCAAAAAAAAAAAAAAAAAAAAAAAAAAAAAAAAAAAAAAAAAAAAAA
AAAA
> SEQ ID NO:17   25043_300074_1   Arabidopsis thaliana, antisense
ATAGACATGTTTCTTCGCGGTCACCACATAGCAAGCATTCTCAGCACAAG
AACACTCTCTACTCTTCTCATGACAAATCCAGGTCGAAGCGGTCAAGGTC
CAGATCAAGATCCCCCCACAGGCGCCATCGTAAATGAACACTCTAGCAAA
CTGGTCTGAGACTGTACCCGGGACAATATTGTGCGCGGTGGATCACAGGA
TTGGGTTAATGTACTGGACGGACATCGATATAATCAAAAACTATAAAGTC
ACCGGTTTGTGAGCGAAATAGTGCATAGTAAACCGCTCTTTCCTTAGTTC
TTCAGAAGAAATATCCAAAGATTTTTGACTGACTTGTTTGACAATATCGT
TGGTTGGTTAAGCGTTCCTATGTAAATTTTGTTCCCTCTGAAAAAA
> SEQ ID NO:18   25056_300074_1   Arabidopsis thaliana, antisense
TTTTTTTTAATAATAATATTATATTATTATTGATATTCGAATGAGTCAAA
TTCAACAGCGATACATAATAGAGAGATAAAAGACATCAAACATAACCAAC
ATGAAATCAACTAGAACTCAAAACAAGACCAGACTTAAACATCATCAATT
AGTTGATTTTACTTTAAATTCATTTAAACATAAAAAGCAAAGAAGAAACT
TCTTAAAAGAAGAATCCAAAGGCCATCACCGCTACGGAGGCGAAGAAAGT
AGGGATAAATGAGGAAGCATCGGAGGTAGGGCTAGGCGCGGGAGCGTCAA
CCGCTGCAACCGTCTGGTGAACTGTAGAGAACGCTATCACTGCCACCAAA
ACCGCCACGAAAAGCTTCATCTTCATTGCCTCCATTGTTAGTAAATGAAG
AGAAGAAAGAGGTTTTGGTGCTTACTGTTGTGTTGTTGGTT
> SEQ ID NO:19   25057_300074_1   Arabidopsis thaliana, antisense
TTAACAAATAGTCATAACAATAAAATATATAAAAAATAATAATATTAATA
ACAATAATAATAATGATAATGGGAGAAAGAAATCCCTAAAAAAAAATTGA
AAATGGGAGAAAGAAACCAAGAAGGTTTTGTTTCATCTCCTTTCTTCCC
ATAAGCCTTTTTCTTGTATTGTTCCCTTCTCTTCTCTAAATAAAAAAAAA
AAAAACTGTTTTTTGTGAAAATTAATTGACCAAAAACAAAGAAATCTTCT
TTCTTCTCTTCTCTTCTTTGTTAATCTTGTTACCCTTCTACCACCACCAC
CTGTAAAAAGAGGTTTTTATCTACCACATAGAGAGACCAGACAAGAACA
TGTGATTCTTTGGTTAGGTCTCTCAATTCTGCTGAGCCACAAGCTGATCG
AGCTGCATTTGCTCAATCCAAGCTTCTAGCCCAGCATGATCCATTACCGG
TTCAACCGGATTTGGCTGCTTCATCACGTGTTCCCCTGAGGAAGATGTTG
CTGCTTTCTCTTTGGCTTCTGCTGGAGTCTCCTTCACCAGTGACTGGACC
CATGACACATCAGGCTCATCACCATCAAACGATGACGAAGATCTCAACTT
ACCAAGTGCTTCTGAGCTCATTCCCCAATCCGGTTGACCATTTGAAGATC
CCCATTTTGATGACCATGTGTTGTTGTTTACCGGTGAACCAACGATTGGG
CTAGAGTTTGTTCTGAGCTCTCTGGAGCTAAGGCTACGGAACTGATGTTG
CTGCTGCTGCTGCTGTTGCTGTTGTTGTTGCTTCACGCACTGAGCCA
ACATGGAAACCCG
> SEQ ID NO:20   25059_300074_1   Arabidopsis thaliana, antisense
ATAGACATGTTTCTTCGCGGTCACCACATAGCAAGCATTCTCAGCACAAG
AACACTCTCTACTCTTCTCATGACAAATCCAGGTCGAAGCGGTCAAGGTC
CAGATCAAGATCCCCCCACAGGCGCCATCGTAAATGAACACTCTAGCAAA
CTGGTCTGAGACTGTACCCGGGACAATATTGTGCGCGGTGGATCACAGGA
TTGGGTTAATGTACTGGACGGACATCGATATAATCAAAAACTATAAAGTC
```

Figure 1f

```
ACCGGTTTGTGAGCGAAATAGTGCATAGTAAACCGCTCTTTCCTTAGTTC
TTCAGAAGAAATATCCAAAGATTTTTGACTGACTTGTTTGACAATATCGT
TGGTTGGTTAAGCGTTCCTATGTAAATTTTGTTCCCTCTGAAAAAA
> SEQ ID NO:21 25062_300074_1 Arabidopsis thaliana, antisense
TATGTGAGAGATATAGTAACTACAACTGAATGAAAAATCCATGAGACAAA
AAAGTTCGCAATAGAAGAATATTGATTCGGTAACAAAGCACAGCTTATAA
GTTTTCTTGTGTTAAAGATGAACCAATTTGAAGCATTAGAGGATAAACTG
GACTAAACTCTTTGTCCCCTCTCGATCTGATCTTCACTGCATAATCATCC
AAAGTTGCTTTTATCCCTTTCCAGATCTGATCCTCTCTTTGGTTATCAAG
CCACAGTGAGTACTGTTTAGGACTTAGTCTGTTCTTCTGCATCGGTGACT
CTAACTCGTCTGGGCCTCTTGTGTAGAGATGATGTAGGACGATGCTCGGT
GGTAGATCATTGATGAGAGGAGATGATCCCATTTGAGATGTTTCCAGGAA
AACCAAAGGCCTAAACGCTCTAAGAGCTCTGTACGGTGCTCCGAGTTGTT
CCACGGGAAATAGATTCTGTCCCACTGCTAGTTCCAGCTCGGCCATGTCT
TTGGCCATTCTGAGTTTTCCCCATTCTGAAAGTGGTCGCACAAGGGATGC
ATGTCTGATGTAGAAGATCAAAACCCTTGACGCCATTTGTCTTGTGAGTC
TTGTGCAGATCGATTCTGTTCCTGC
> SEQ ID NO:22 25066_300074_1 Arabidopsis thaliana, antisense
AGAAACGATGAGTTCTCAGATTTCGGAGATTGAACAAGAGCAGCTGATCG
AGAAGCTTGAGATCTTCAAGATCCATGGCAGAGACAAACGTGGCCGTAAG
ATCCTTCGTATTATCGGAAAATTCTTCCCAGCTCGATTTCTGTCACTGGA
TGTGTTGAAGAAGTATCTAGAGGAGAAGATATTTCCTCGATTAGGTAGAA
AACCATTCGCCGTACTCTACGTCCACACCGGCGTACAGAGAAGCGAGAAC
TTCCCAGGTATCTCAGCTCTACGAGCGATCTACGACGCAATTCCGGTAAA
CGTCAGAGACAATCTTCAGGAGGTTTACTTCCTCCATCCAGGTCTTCAAT
CACGTCTCTTCCTCGCCACCTGCGGCCGATTTCTATTTTCCGGCGGGTTG
TACGGGAAGCTGAGGTACATAAGCAGAGTTGATTATCTGTGGGAACATGT
GAGGAGGAATGAGATAGAGATGCCGGAGTTTGTATACGATCACGATGATG
ATCTGGAGTATCGTCCGATGATGGATTACGGTCAAGAAAGCGATCACGCG
AGGGTTTTCGCCGGAGCCGCCGTGGATTCATCAGTCTCAAGTTTCTCCAT
GAGGTGTATCTCATAGCGTAAAAGGCTAAAACTCCACCCACTAGATATCG
GATCGTATCTTATAAACCATATAATATACGAATACGATTAATAATATATC
AAAAAGATTGGAAATAGGTGTGCTTTTTGAAATTAGTGAGCGTTTTTTAT
GGAAAAGAAAAGAAAAGAAAGCAGTTGGCGTCTGGATAAAGGGAAGGAGG
AGAATCTTTAGATTTTTTCTTTAATCTGTTTTTCTTTTGTCTTGATTAGT
TTTTTCTTTAGTGGTGGTGGTTGTGAGTTAGTGTGTAAAATGTATATTGT
CATATGTGAATTTAATAATAAGTCCTTTTGTAAGATGATCAAGGGGAAAA
AAAAAAAAA
> SEQ ID NO:23 25080_300074_1 Arabidopsis thaliana, antisense
CTGGATCTTGCTAAGGTTCTTTTAGAGATGTTGACGGCCAACAAAATGGC
CAAAGCATTTTTTACAAGCGGTGGATCAGATGCCAACGATACCCAGGTCA
AGCTGGTTTGGTATTACAATAACGCACTTGGAAGGCCCGAGAAGAAAAAG
TTTATCGCGAGAAAGAAATCGTACCATGGCTCCACTCTAATATCAGCAAG
TTTGTCCGGCCTTCCCCCGCTACACCAAAATTTTGATTTACCTGCACCAT
TTGTGTTGCACACAGATTGCCCTCATTATTGGCGTTTTCATCTTCCAGGC
GAAACGGAAGAGGAGTTCTCAACCAGATTAGCCAAGAATTTAGAGGATCT
AATCATCAAAGAAGGACCAGAAACTATTGGTGCTTTTATAGCTGAACCAG
TCATGGGTGCTGGGGGTGTGATACCTCCACCTGCTACCTACTTTGAAAAG
GTTCAAGCTGTTGTTAAGAAATATGATATCTTGTTCATTGCTGATGAGGT
GATATGTGCATTTGGAAGGCTCGGGACAATGTTTGGCTGTGACAAATACA
ACATTAAGCCAGATCTTGTGACCTTAGCTAAGGCACTGTCTTCAGCATAT
ATGCCGATTGGAGCCATTCTTATGAGCCAAGAAGTGGCAGATGTCATAAA
TTCTCATAGCAGCAAGCTAGGCGTTTTCTCCCATGGATTTACTTATTCTG
> SEQ ID NO:24 25101_300074_1 Arabidopsis thaliana, antisense
CTTTCATGTGAGAGAGAGAGTTGAATTTTGCAGATGAGTATGAGAAGAAG
CAAAGCGGAAGGGAAGAGGAGCTTACGAGAACTGAGTGAGGAAGAGGAAG
AAGAAGAAGAAACTGAAGATGAAGATACTTTTGAAGAAGAAGAGGCTTTG
GAGAAGAAGCAGAAAGGTAAAGCTACAAGTAGTAGTGGAGTTTGTCAGGT
```

Figure 1g

```
CGAGAGTTGTACCGCGGATATGAGCAAAGCCAAACAGTACCACAAACGAC
ACAAAGTCTGCCAGTTTCATGCCAAAGCTCCTCATGTTCGGATCTCTGGT
CTTCACCAACGTTTCTGCCAACAATGCAGCAGGTTTCACGCGCTCAGTGA
GTTTGATGAAGCCAAGCGGAGTTGCAGGAGACGCTTAGCTGGACACAACG
AGAGAAGGCGGAAAAGCACAACTGACTAAAGACGGTGAAACGTGTGAGAT
CCCGGTTTGAAGGTTAATGAAACAGGCTTTGCTTACTCTCTTCTGTCAGT
CTCTTTTAGCTCCTTGTAATCCTCTGTGTCTCTGTCTGTTTCTCCATATT
ACCTGTAATCAAAGCTATCTGCTAAACCTACGACATGGTTAAATAAATGC
ATTGAGACTTAGTAAAAA
> SEQ ID NO:25   25103_300074_1   Arabidopsis thaliana, antisense
ATCTTATGCAAGAAGTTGCTGTGGAGACATTTGGTGCTATGGCAAAAACT
GAGAAAATTGCATTTATCCTTGAACAAGTTCGCTTGTGCTTGGATCGTCA
AGATTTTGTTCGTGCACAAATCTTATCTAGGAAGATCAATCCTAGAGTTT
TTGACGCAGATACAAAAAAAGATAAGAAGAAACCTAAGGAAGGTGATAAC
ATGGTAGAAGAGGCTCCTGCTGATATACCAACCCTTTTGGAGCTTAAGCG
AATTTACTACGAGCTTATGATTCGGTACTATTCTCATAACAATGAGTACA
TTGAAATCTGCCGTAGCTACAAGGCGATATATGATATCCCTTCAGTAAAA
GAAACTCCGGAGCAGTGGATTCCGGTCCTGAGGAAGATCTGCTGGTTCTT
GGTCTTGGCACCTCATGACCCAATGCAATCAAGCTTGCTCAATGCAACTC
TGGAAGACAAGAATTTATCAGAAATCCCTGATTTCAAGATGCTTCTAAAA
CAGGTAGTGACAATGGAGGTTATTCAATGGACATCTCTGTGGAACAAATA
CAAGGATGAGTTCGAGAAAGAGAAAAGCATGATTGGAGGTTCTTTGGGTG
ACAAAGCTGGTGAAGATCTGAAACTGAGAATCATCGAACATAATATCCTC
GTTGTCTCAAAGTACTACGCAAGGATAACCTTAAAGAGACTTGCCGAGCT
TTTATGCCTGAGCATGGAGGAGGCGGAGAAGCATCTATCGGAGATGGTAG
TGTCAAAAGCACTGATTGCAAAAATAGACAGACCATCTGGAATTGTGTGC
TTCCAGATCGCAAAGGACAGCAACGAGATTCTAAACTCGTGGGCAGGGAA
TTTGGAGAAGCTTCTAGATCTTGTGGAAAAGAGTTGCCACCAAATTCACA
AGGAAACCATGGTTCACAAAGCCGCTCTCAGACCTTGAAAACATGCGGTC
TTCTTCATGAAAACTTTTCAGGATCTTCTTCGTTGAGTTATTAGCATCTT
TATGTGGTAAAAACTCGAATCAGTGTTTCCTTTTAAAAATTGTACTATGG
ATCTGTACACTAACGAAGTGTTTTGCCACTTATTGGTTAAAAAA
> SEQ ID NO:26   25104_300074_1   Arabidopsis thaliana, antisense
TTTTGAAACATAAACAAAACTCTTATTTATTAAGGACTTGTGCTAAATAC
ATTTAGCCTCAAACATCCAAAACTTACATTTTCATAAAAGACACGATGAG
GTGTGGTGTTAACATGTATCAACAACCACACTCTCATACGCTCGAGGGTT
TTTGTTTGGAATCTATTAGTAAGGAGGGAAGAAAGGGATGGTGGTCTGGA
AGGGGCATTCACCAACTTGCTGGATCTTGCAAATGTTAGGCAAGTACTTA
GCTGTCTTGTAAATTTTCCTGGATTGGAATGGTCCGTGTTGTCCCTGGAG
GCTAACGGCCCTGGCAGCTTGTCTCAAGGTGGGGCAAACACAAACTGGCT
CTTCCTGGCGAAGCTCG
> SEQ ID NO:27   25108_300074_1   Arabidopsis thaliana, antisense
CTAATGGAAATACCGAGGCGAATGTAGTGGAAGCTGTAGAGAATGTAAAG
AAGGATAAGAAGAAGAAGAAGAACAAGGAAACAAAGGTGGAGGTAACTGA
GGAAGAGAAGGTCAAAGAGACTGATGCTGTGATTGAAGATGGAGTTAAGG
AGAAGAAGAAGAAGAAGGAAACTAAGGTGAAAGTAACCGAGGAGGAGAAG
GTCAAAGAGACTGATGCTGTGATTGAAGATGGAGTTAAGGAGAAAAAGAA
GAAGAAGAGCAAGTCGAAATCTGTTGAGGCTGATGATGATAAGGAGAAAG
TTTCAAAGAAAAGGAAAAGATCAGAGCCTGAAGAGACTAAAGAAGAGACT
GAGGATGATGATGAAGAATCAAAACGTAGGAAGAAGGAAGAGAATGTAGT
TGAAAACGATGAGGGTGTTCAAGAGACACCTGTTAAGGAGACTGAAACTA
AGGAAAACGGAAATGCTGAGAAAAGTGAGACAAAGTCAACAAATCAGAAG
TCAGGAAAAGGGCTTTCTAACTCAAAAGAGCCGAAGAAACCGTTTCAGAG
GGTGAACGTTGACGAAATTGTGTACACTGAGAATAGCAACTCGTACTATT
CAAAGGGTGGTGCTGAAATTGGCTATGGTCTTAAAGCTCAAGAGGTTCTC
GGGCAAGTGAGAGGAAGGGATTTCCGACATGAGAAGACGAAGAAGAAACG
AGGAAGCTACAGAGGAGGATTGATCGATCAAGAGTCACATTCGACTAAGT
TTAATAACTCAGACGACGAAGAATGATTGATAAGCAGACAACACTGCCTT
```

Figure 1h

```
TTTGACATTGCTTCGTTTCGATTTATCTTTTTCTTTTCTTTTGCTTTGAT
CATTTCAATACCCGTAATAGGGCTCAAGTTTTGTGTCTGTGCACTCCTTT
GATACTTATATGAACATGATTCAGTTTCAGTTTCTTGTTCAAAAAAAAA
> SEQ ID NO:28   25109_300074_1   Arabidopsis thaliana, antisense
TTTTTTTTTTCTCTCGCAAACAGAAATTTATATTGACTTTTAAGAACAAA
TACAAAGTATATCTATCACACAACTCACAAAAGAGATAGGTACAAACATA
ATGACAAATCACAATCAGCACACCATTACATTAAAAGTCAAATTTACCTT
TTTAATAAGAAGATACAAAAATATATAAAGAGAAGACCAAGACAATTTGA
CTTGAGTGATTAGGAGGCATTGTTGGCCTGTAATAATCCATTTCGAATCT
GCGTTGCCACGTCAGCGACGGCGCCTGGACCGTGAGGGATAAACACCGCC
GAGGCTTTAGAAGTTGCTCCGATATCTCTCATTGTGTCAAAGTACTGAGT
CATCATCACCATGTCCAACACATCCTTCGCTGACGTCCCTGGCACGTTTC
CTGCGAACCCTAGAACACTGTCTCTCAGACCGTCCACGATCGCTTGTCTC
TGCCGAGCGATTCCGAGTCCGACAGGTACTTTGACTCTGCTTCACCCTC
TGCTCTTTTGATCTGAATGATTTTCTCAGCCTCTGCTTTTCGCTCGCTG
CCACTCTCATCCTCGCCGCGGCGTTGATTTCGTTCATGGCACGTTTAACC
TGTTGATCAGGCTCAATGTCGATAATTAGGGTTTGAAGGATTTCGTAACC
ATAAGCAGTCATGGCTTTGTCTAGCTCTTCTTCCACAGATTTGGCAATTT
CATTCTTCTGC
> SEQ ID NO:29   25118_300074_1   Arabidopsis thaliana, antisense
GAACATCAGAAAAAGGCATGTAATATTAATTCAGCCAACATCTGTGGATA
TGCAGGTGTTGAAGAGAAACGGTACAAATTAAAGTTGATTTCTTTTACTT
TGTTACAGCTACGTACCATACAATCACCCAAACATACAAAACCTTAAAAG
ACAAAAGTTGGCATCTCTATCAGTTGGGTTCTAGTCAATCTTCACTGAGG
AGTAGATCTTTCTCACGAACCAGAAGCAAGCATAGAAACCGATTGTGCCA
GTTAGGACGAAGAATGCGTAAGAGATGATAATCATGTACCCGAAGTAGAG
CATTCCCGAGACTAGCTTTGTGATCTCCAGCTTTGTGAAGAAGTAGAAGA
TTGAGTAGAGGAAGAGGTAGAAAGCGGATGAGCCCGCAGTTAAGTAAGCT
CTCCACCACCAGTTGTAGTCTTCGCTACAAAGCTGGAAGTAGCAGAGCAC
CACTGTGATCTCTGCACAGGTGACGATCAAGATCAAAAAAACTATAAAGA
GGAACCCGAAGATGTAGTAGAACTGGTTCAGCCATATAGATGTCAAGATG
AAGAAGAGCTCGATGAAGACTGCTCCAAACGGGAGAATGCCTCCAATTAG
TATAGAGAAAACTGGTTTCATGTACCACGGCTGCTCTGGTACTTGCCTCG
GGATCTTGTTTGTTTTGACTGGATCTTCAATTGCTGGCTTCTTGTAACCC
AGATAGCTACCAACGAAGACTAGTGGGACTGAGATGCCAAACCAGAGGCA
GAAGAGAGCAAACATTGTACCAAATGGTATGGCTCCAGATGACTGTTCTC
CCCAAATAAGGGCATTCAGAACAAAGAAGATAGCAAAAAGGATACCGGGA
AACATGAATGCAGTCTTCAAGGTCATTCTCTTCCACTTGTTTCCTTTGAA
CATTTTGTGAAGGCGAGACGAGGAGTAACCAGCGAATATGCCCATGAAAA
CCCACAAGAGAACCATGGCAGTCATAAGCCCTCCTCTGTTGGATGGAGAT
AAGAAGCCAAGCAACGCAAACATCATTGTAACAAGTGACATTCCGAAGAT
CTGAACACCTGTACCAACATAAACACACAATAAACCAGAGTTCACCGGTG
GCCTGAAGACATCTCCGTGTACAAGCTTCCAT
> SEQ ID NO:30   25119_300074_1   Arabidopsis thaliana, antisense
AGTGAAGCAATGGAGTCCAGATGGAGTGACTCGGATTGGTGTGATTGGGAA
ATCGGTATATTCCGTGAAATTCTCCGGTATATCTACCCGGAAGATGCTCCA
CCAACCGTCGTCTGCTTG CGGACGCGTGGGTCGACCCGGGAATTCCGGAC
CGGTACCTGCAGAGGAAGATGAAGATTTAAGTTGGGACATTGATGAAGATG
ACGAAGAAGAATCATCATCATCCAAAGCTTAATGTTAGTTTTAAAGTGGTG
TGCTTTCTTACTTTTGCCAATCCTTTTACTTGTTTTTACAAGTTTCTGGCG
CTTTGCCCCCATTCTTCAGTTGTTTCTCTTCAACGTTTCTATTTTACAT
TGATTTGAAAATATGTTTTTAAATTTTAAAAAA
> SEQ ID NO:31   25120_300074_1   Arabidopsis thaliana, antisense
GAAGAAGAAGAAGTAATGGCTTCCTCTATGCTCTCCTCTGCCGCTGTGGT
TACCTCCCCGGCTCAAGCCACCATGGTCGCTCCATTCACTGGTTTGAAGT
CATCCGCTTCTTTCCCGGTCACCCGCAAGGCAACAACGACATTACTTCC
ATCACAAGCAATGGGGGAAGAGTTAGCTGCATGAAGGTGTGGCCACCAAT
CGGAAAGAAGAAGTTTGAGACTCTATCTTACCTCCCTGACCTTACTGACG
```

Figure 1i

```
TCGAATTGGCTAAGGAAGTTGACTACCTTCTCCGCAACAAGTGGATTCCT
TGTGTTGAATTCGAGTTGGAGCACGGATTTGTGTACCGTGAGCACGGAAA
CACTCCCGGATACTACGATGGACGGTACTGGACAATGTGGAAGCTTCCAT
TGTTCGGATGCACCGACTCTGCTCAAGTATTGAAGGAAGTTGAAGAATGC
AAGAAGGAGTACCCGGGCGCCTTCATTAGGATCATCGGATTCGACAACAC
CCGTCAAGTCCAGTGCATCAGTTTCATTGCCTACAAGCCCCCAAGCTTCA
CTGATGCTTAAATCCTTTTCTGGAATATTCAATGTTGACTATCCGGAACC
CAATTTGTATGGTCAATGTAAATTTAAGTAATTATTTTGCCAAAGTGAA
AAAACTGAAGGTTTGTTTTCTATCATTTCCTCTATAAAATCTCTATTC
ATATCACTTCA
> SEQ ID NO:32   25121_300074_1   Arabidopsis thaliana, antisense
AGCAACCTTTCTCTGAATTCGGGGAAATAGTGTCTGTCAAGATTCCTGTT
GGTAAAGGATGCGGATTTGTTCAGTTTGTTAACAGACCAAATGCAGAGGA
GGCTTTGGAAAAACTCAATGGGACTGTAATTGGCAAACAAACAGTCCGGC
TTTCTTGGGGCCGTAATCCAGCCAATAAGCAGCCTAGAGATAAGTATGGA
AACCAATGGGTTGATCCGTACTATGGAGGACAGTTTTACAATGGGTATGG
ATACATGGTACCTCAACCTGACCCAGAATGTATCCTGCTGCACCTTACT
ATCCAATGTACGGTGGTCATCAGCAACAAGTTAGCTGAGGAAACTAAAAG
CTTAATCTGAGCATCTATCTATAGGACAACAAAAACTCACTCAGGTTAGG
TGATGTTAGGAGGTATAAGGCAAAAGTGGTTGGCTTCTTGTCTCTACTTG
AGTTTAGGGTTTATCATCTTTTGGACATCGAATTTTGGTGGAAATCATAC
AGTAATTTAGGAGACTTGGATTTGATTGATTAATTTGATTTGTTTCTTCT
GATCTTTTTGACTATTGAACTTATTGATCAAAGAAGTGAGTTGCACCAAA
AAAAAAA
> SEQ ID NO:33   25122_300074_1   Arabidopsis thaliana, antisense
GTACAATGTCTCCTATGTCTACCATGCCCTAGATGCCTACATCGAGAGAG
ACAATGTCGGCTTGAAAGGTTTCACCAAGTCAGTTTCTTTAGTCTAAAGG
AAAACCGTATTTGTGTCTCTTCAGCTGGTGGATCATCTTTTTGTTATTGT
TGAGGGTTTAACGCTAATAGGTTCTTTAACGATTCAAGTCTTGAAGAACG
AGGTTATGCTGAGAAGTTTATGGAGTATCAGATGCATTGTTTGCGATGGA
GCTTGCACTGACTTTGGAGAAACTTATTAATGAAAGCTTCTGAAGTTAC
AAAGTGTTGGTGTGAAGAACAATGATGTTAAGCTGGTTGATTTTGTAGAA
TCTGAGTTTCTAGGCGAGCTGGTCGAAGCCATCAAGAAAATCTCAGAGTA
CATAGATGGAACAAAAATAAGGTCAATGCAGTGGTGAAGCTGAGATCGGA
TGTTTCTGATATAAGCTGGCAAGTGAAGATGGAGGGTCAAAGACTAACCC
AAGGCTGGCAAAAGTTCGCAACAAGCCACGATCTCCGAGTCGTCGACATA
GTTGTTTTCAGACATGATGGAGATTTCTTCTCAAAACTTTGAATTCTTTG
AATTCTTTGTTTCGAGATCTATCGATACTCGACATCAAAGAACTCCTTAT
AACTCTTGATTCATTGAAACAAGAGTAGGCATGTCAATCGAGCTATCCCG
GTCCGACCCGAAACCCGTAATACCCGTATATGTTTGAGTTTGGGTCAGAA
AAGCTCTGAGCCTATATTTTAATTTAGGTATTTCCTGTATTTTTTATTTT
TTGTATTCAATTTCTCCAAAATTAGTGGAAATTATCCATATTTTCTTTCT
ATTTTTTTAAAAAAAAAAAAAAAAA
> SEQ ID NO:34   25123_300074_1   Arabidopsis thaliana, antisense
GTACAATGTCTCCTATGTCTACCATGCCCTAGATGCCTACATCGAGAGAG
ACAATGTCGGCTTGAAAGGTTTCACCAAGTCAGTTTCTTTAGTCTAAAGG
AAAACCGTATTTGTGTCTCTTCAGCTGGTGGATCATCTTTTTGTTATTGT
TGAGGGTTTAACGCTAATAGGTTCTTTAACGATTCAAGTCTTGAAGAACG
AGGTTATGCTGAGAAGTTTATGGAGTATCAGATGCATTGTTTGCGATGGA
GCTTGCACTGACTTTGGAGAAACTTATTAATGAAAGCTTCTGAAGTTAC
AAAGTGTTGGTGTGAAGAACAATGATGTTAAGCTGGTTGATTTTGTAGAA
TCTGAGTTTCTAGGCGAGCTGGTCGAAGCCATCAAGAAAATCTCAGAGTA
CATAGATGGAACAAAAATAAGGTCAATGCAGTGGTGAAGCTGAGATCGGA
TGTTTCTGATATAAGCTGGCAAGTGAAGATGGAGGGTCAAAGACTAACCC
AAGGCTGGCAAAAGTTCGCAACAAGCCACGATCTCCGAGTCGTCGACATA
GTTGTTTTCAGACATGATGGAGATTTCTTCTCAAAACTTTGAATTCTTTG
AATTCTTTGTTTCGAGATCTATCGATACTCGACATCAAAGAACTCCTTAT
AACTCTTGATTCATTGAAACAAGAGTAGGCATGTCAATCGAGCTATCCCG
```

Figure 1j

```
GTCCGACCCGAAACCCGTAATACCCGTATATGTTTGAGTTTGGGTCAGAA
AAGCTCTGAGCCTATATTTTAATTTAGGTATTTCCTGTATTTTTTATTTT
TTGTATTCAATTTCTCCAAAATTAGTGGAAATTATCCATATTTTCTTTCT
ATTTTTTAAAAAAAAAAAAAAAA
> SEQ ID NO:35  25124_300074_1  Arabidopsis thaliana, antisense
AAAAGAAGCTTCATGTATCTGATGAAGATTTTGCCAAGTGGAAGTTTGCG
TTCATGTCAATGGGGCGTCCAGAGTACTTGCAGGACACAGATGTTGTTTA
TAATCGCTTCCAGAGAAGAGATGTCTATGGTGCTTTTGAGCAGTACCTCG
GGTTGGAGCATGCTGACACTACTCCTAAGAGGGCTTATGCTGCAAACCAG
AACCGCCATGCTTACGAGAAGCCGGTAAAAATATACAATTAGCCCCAAAA
CATGAACACAAATGTCAGGAGACATTGTGGCAGCAACGTTGGACCAAGGC
ATTGATTGGACCAATGCATCGAATAAGAAGGGAAAGGGCGAGTGTGAGGG
TGTGATGATGACCGTAGGATGTTGTAGAGAATCTGGTCTGATAGGGTTTT
GGGTTGCGCATTGATAGTGGTGTGTTTCTATTTTTTCTTTTCAATCTA
TCCTTATTTTATTTCGTGCTTCAATACTTTGTGTTAATATCTGGAATGTG
TGAAGACCATTGCACATGCAATTTTTATTTTCCAAAAAAAGAATATGGAA
GCCCTTCGCTTGGAAAAAAAAAAAAAAAAAAA
> SEQ ID NO:36  25130_300074_1  Arabidopsis thaliana, antisense
AGTTATTAAGCTTTTAAATTTTATAAATAATTAATTATTATCTTAACTAA
TCTTGATCTTTTTTATTTTTTATTTTTTTGGTTAGCTGGAAAATAAATTG
TCGGCAATTACAGATCAAAATGAGGCGGAGAAATATGTAGATGTGATTGA
CCCAAGGGATATTAAGATTGGGAGCAGAAAATTTTATAGATACATTGGAT
CACTTACTACTCCTCCTTGTACGCAAAATGTTATTTGGACCGTCGTTAAA
AAGGTAAATACTCATCGTTATTTCTTCTCTTTTTACTTAATCAAACAT
AGCATTAATAGATCATTACAAGGTACTAATAGTGTGAATATCCATATCCA
AAAGGTTTATCCATCTACATGTTAACTAGGTCTATTTTTCCAATTTTAAA
TTTTGACTTTTTATTTTAAAATCATTCGTTTAAATTTATTTGGTTGGTTT
TTTAGGTAAGGACTGTGACGAAAAACCAAGTGAAGCTACTCAGAGTGGCG
GTTCACGATGTAAGTTTTACTTAAATAATTTACTTAGTGAATTTCACAAC
TATACTATATCTTAGAAGTTGAATGTATATTATATTTGTTTATTATCAAA
AATGTAAATATGATTGAAAAATAAATTTGCAGAATTCAGATACAAATGCG
AGACCAGTTCAACCTACAAATAAGCGCGTGGTAAAGTTATACAAACCAAA
ATCACTATGAATCAAGGCGTCACATGAATCAAATACAATTAATTTATTTC
AATTTTTTACAACCACAGTGTACTATTTATTTAATTTTTTTGTTCACCAA
AGTTTTTATATATAACACGAAAATATATGATGTATGTGTTTTCCTGAGT
ATCCTATGGTGTCCCATCTTCCTCCTGTAGTTTCAAGATCTTCAATCCAA
TCTAATTCAAATATAAAAAAAAAAAAAAAAAAAAAAA
> SEQ ID NO:37  25133_300074_1  Arabidopsis thaliana, antisense
GAAGAATCCGAATCCAATTCAATGAGTCTTCTTCGTCTTCTCCTCGTTGT
TGTTGTTCTTCATCTTTCTGCGGTGGCCGGCGACGACGCCATCGTCTCCA
GATTCCAGGAGTACCTCCGAATCAACACGGTTCAGCCCAACCCGGAATAC
TACAAAGCCGTTGACTTTATAATATCTCAGGCGAAACCACTGTCCCTCGA
ATCTCAGACGATCGAATTTGTAAAAGGAAAGCCGCTTCTCCTCCTCAAAT
GGGTTGGCTCCGACCCAACCCTACCTGCCTTTCTCCTCAACTCCCACACC
GATGTCGTTCCCTTCGAGGACTCCAAGTGGACTCACCATCCGCTCCAAGC
TCACATGGACCACCATGGCGACATCTATGCCAGGGGTTCCCAGGACATGA
AGTGCGTCGGGATGCAGTACCTCGAGGCCATACGCAAGCTCCAGGCTTCT
GGCTTCAAGCCACTCCGATCCGTCTATCTCTCCTTCGTCCCCGATGAAGA
GATTGGCGGCCACGATGGCGCAGAGAAGTTTGCTGAATCCCAATTATTCA
AGAGCTTGAACATCGCAATCGTGCTCGACGAAGGCCTGCCATCGCCTACT
GAGAGTTACAGAGTATTCTATGGAGAGAGGAGTCCCTGGTGGCTGGTGAT
TAAGGCTAAAGGTCCACCTGGCCACGGTGCCAAGCTCTATGACAACTCTG
CCATGGAGAATCTGCTCAAAAGCATTGAGAGTATTCGCAGATTCAGAGCT
TCTCAGTTCGATCTTCTCAAAGCTGGTGGGATAGCTG
> SEQ ID NO:38  25134_300074_1  Arabidopsis thaliana, antisense
GATTCTCTCTCTAGCGATGTCGATCAAACCGGAGAATTCTCCGATTCCGT
TGATTGGGATTAATAATACGTGTGAAATCATGGTGTCTTTGAGTTCATGA
AGAACGGAGGTTAACCTAATCGAAGATTTGATTTGGGACTGCGAATGAGA
```

Figure 1k

```
GAGAAGACGTTGAAGGCTCAAATTGGAGATTTCTATGAATTTGTTGATTT
GAGAGAAGAATTGAGGCTCATTCGTAACGGAGGGAAGGTGACGGTGACGG
CGATGGTGAATTTATAGTTGTACACGGAGCTGGAACTCATCAAGGACAAA
GAAGGCAAAGCTACTCATCTACTTAAGTTCTGCTCCAAAGCTGAAATACG
GAGATTCAGATCCTTTGTTCCCATGAATCAACTACAGACGCTTTAATAAT
CTGAGGGAATCTTCCGTGCCAATATGGAGAGATCATCATCATCATCATCA
TCATCATCATCAACATCATCATCATCATTATCATCATCATCATCATC
GTCATCGTCATCGTCATCATCATCGTCATGTGATCAGGTAATATTGACTG
GATCAGCAAATTCGCCGACGAATTAGAGTGGAACCTCAGAGGGAATTTTT
TTTTTACGATTTGTCTAATCTGATTCGAAATTTTGTCTCGTGGTGATGCC
GATGAAATAGAAGATGTGTACCTTTCATATCATTCACTCTGGTTTTATGG
GATCAGAAGAAATTAGCGAGAGTAAAATCTGTGGACCTGCACCATGTAAC
TTGATTATGGCACTCAGTCCGAGTAAGGTTCTGACACATGTTATCTCATT
CTATGTTTACATGCTTGTTCATCTTCAGGTTTGGAATCTTGGTTTACCTT
ACCCAACTTTTACATTGGCCATTGACGATAAGCCCTATCTAAATACCGTC
TCTGATGATCACTCTGTTAAGGTCAAAAATGTTGATTGGATCAGCAAACT
CCCTGACGATGTATTGCTCATAATATTATCGAGACTTTCCACAGAAGAAG
CCATAAGGACGAGTGTTGTGTCGAAGCGATGGGAACATGTGTGGAGTCAA
ATGTCTCATCTCGTCTTGGACATGCGGAAGAAGATTATCAATTCCAACAA
CACGCCTGATGGTTCGAATCCAGTTGCTACATTGATTACTCAGGTTATAA
ACAATCATCGTGGACATCTAGAGAGCTGCGTGATCATGCATGTCCCATAT
CAAGGTGGAAATGGAATGCTCAATTCTTGGATTCGATTACTGAGTTGCAT
GAAACGCACGAAAGTTCTCACACTTAGAACCATTATGATACTTGGGATCG
AAAGTTCAAAACTTTTAACTTTTCTCCCGACTCCTTGTCCCATCCAAGTC
TTATGTCACTCTCGCTACATTCATACTTTCTCGAAA
> SEQ ID NO:39 25136_300074_1  Arabidopsis thaliana, antisense
CAATAGTCATGGCTAGAAACCTTGAAGAGGAATCAAGTGGTGATACAGAG
TTCATTAAAGCCTCTTGTGAGACGACGTCGTACCCAGACCGATGCTTCCA
GTCTCTGTCTTCATATGCAAGCGAGATCAAGAAGCAGCCACGTAAGCTTG
CTGAGACCGCGCTTGCCGTTAGCATAGCCCGAGCAAAGTCAGCCAAAACC
TATGTATCAGAGATGACTGATTATAAAGGAATCACAAAGAGGCAGCACGA
GGCTGTAGCGGACTGTCTAGAGGAGATGGGAGACACTGTTGACAGGTTGA
GCAATTCGCTGAAGGAACTGAAGCATCTGGAGGAAGGTGACAGCGGAGAA
GACTTTTGGTTCTGTCTGAGCAATGTCCGGACGTGGACAAGCGCAGCACT
GACAGATGAGACCGCGTGTATGGATGGGTTTGGAGGGAAGGCCATGGCTG
GGGAGCTGAAAAGTTTAATCAGAACACACATTGTGAGTGTTGCGGAAGAG
ACGAGCAATGCCTTGGCTTTGATCAATGACTTTGCTTCCAAGCATTGAAA
TCATTTCAAAGGGGTTTAGTCTTTGGGACAAGAGTTTTTCTCGTATTCAA
CACTGCTTGTGTTTTTTTTTCTCTCTTTAAAGTTTCTACTTTATCTTAAC
TTATCATTTTTCATATTATGCATAAATTAATCTGTATTAAAATTAAAATA
CTTCATAATTCATTTCAAA
> SEQ ID NO:40 25137_300074_1  Arabidopsis thaliana, antisense
CAAAGAAGAAGATTTCCAGAGATACGATGAGTCGTCTGATTCAACATTCT
ACGAAGCTCCAAGGTTTGTGACACACATTGATGATCCAGCTATAGCTGCA
TTGACAAAGTATTACTCCAAGGTTTTGCCTCAGAGCGATACTCCAGGAGT
GAGCATACTCGATATGTGTAGCAGTTGGGTCAGTCATTATCCACCGGGGT
ATAGGCAAGAACGAATAGTTGGAATGGGTATGAATGAAGAAGAGCTTAAG
CGAAATCCGGTTCTCACCGAGTACATAGTCCAAGACTTAAATCTCAATTC
AAATCTGCCTTTTGAAGACAATTCTTTCCAAGTTATAACCAATGTGGTAA
GTGTGGATTATCTTACAAAGCCGCTTGAAGTGTTCAAGGAAATGAACAGA
ATCCTTAAGCCCGGAGGACTCGCTCTAATGAGCTTCTCGAACCGTTGCTT
CTTTACTAAAGCAATCTCGATATGGACATCAACTGGCGACGCAGATCATG
CTCTCATTGTTGGATCATACTTTCACTACGCCGGAGGATTTGAAGCTCCT
CAGGCCGTTGATATATCTCCAAATCCAGGGCGTTCAGATCCTATGTACGT
TGTTTACTCTAGAAAACTCCCCATGGTTTAAACCTGAGATCCAAGCACAT
CATGTATACACATAGTAGAGACCGAGGAAACTAATTCTTCGATTAAGACA
AGGGAACTTCTGAAATCTTGTTTATAAAGAATGTGCCACTCTCTCAACAC
TAATAACAATGTCATATAAAGAATCTGAAGCCAGATTCGCAAATTTGACG
```

Figure 11

ATAAAAAA

> SEQ ID NO:41 25142_300074_1 *Arabidopsis thaliana*, antisense
TTTTTTTGGAAGAAAGTGTAAATACTTGAAACTTTTCAATCTAAAGGTTT
TCACAGTTGATGTGATCTCAAATAACAAAAAAGGTAATACGAACTCATA
AACTGTTGTTCAAAAAGGGAACCAGAGAAACATTGTCAATCTAATTCAGT
TTAGATGAAGAGGCTGCAAAACCCGAACTCAATCTTGTGTGTCGTTTCAC
CATCCTCCTTTGCAGCTGAAGTTCCCTCAGAATATGTGCATCAAGTCATA
AGCAAATGTCCAGAACAGCACAAACGACATAAGGCCACCAAGAAAGCCGT
CAAAAAGGACCCGATTCCACGAATCAAAGTACAAGTCAGCTGAGAATCCT
GCCTTAGCCATGAGCCCAACAGATGTGATCAACATCACCACAAAGTAAAA
TACAAAACCAATCAAGCCATTGAATCCAATTATTCCTGCTAAGACACCAG
CTATGATAGACAGAAACGTCCGGCTGTTTTGAATGACTTTCAAATTGTTC
TGCAAATTCTCTGCACTGAAAGTTGGTATGTCACTCATGATATCCTTTGA
TCTCTTCTCAGATGAACCCATTTAAGATAGCAACAATAATTAGAAACGAG
AGTAGTAAGAGGAAGATCGAAGTAGC > SEQ ID NO:42 25144_300074_1 *Arabidopsis thaliana*, antisense
TTTTTTTTTTTTTTCCAAAAAGGTTCAAAATCATAACACAAAACAAAAG
AAATAAACAGGAAGCTCGAGTGCCAAGTACCTCCGCCACCTCCGATCAAG
AACCCAATTCCGAGAATTGAGCTCCGACGGAGAATAAACGAAGCGGTAAC
ACAAACAACCAACCAAATACCAAACTACTAAAGTAAAGAAACTAAAATAG
TCCTTCATTTCATCAGCGGAAAGAGTTTTGATGTTCAGAGTTCACTTGGC
ACCCTTCTTGA > SEQ ID NO:43 25158_300074_1 *Arabidopsis thaliana*, antisense
GATATGAGTAGCCAAATCGCTTTGTCACCGGCCATCGCCGCCGCCATTCG
CCGTCCGTCCTCTCACGACTGTCTATCCGCTTCCGCCACTACTGCTACCG
CCACCCCCATGGCTCTCAAATCTTGCATCGTCGCACCTCTCTCGCTATTC
ACCTCTCAATCTCAAATCAAACACTCAAGCTCAAGAAAAACTTCTCGAAC
CACGATTCGATGCGATGTAGCGATAAAATCCGCAGATTCGATAAACGCAG
ACGCCAATCCTTCGTCCTCACCGTCATCAGAGGAAGAAATCGAAGCGGAA
GCGAAGGCGAAGATAGGATCTAGGGTTAGAGTAACTGCACCGTTGAAGGT
TTATCATGTAAATCGAGTTCCAGAGGTTGATTTAGAAGGTATGGAAGGTA
AACTCAAAGATTACGTTGCTGTTTGGAAAGGGAAACGAATCTCAGCTAAT
CTTCCTTATAAGATTGAGTTCTTCAAAGAAATTGAAGGTCGTGGTCTTGT
TAAATTTGTTTCACATCTTAAGGAAGATGAGTTCGAGTTCATTGATCAGT
GATGAAACAAGAAAGACAATTTTTGTTTTCCTTTCTCAGTGTTTGTTTTT
GTTGTTGTGTTTACTGGAACCTGGGAATGGAGAATGATTTGTATGTAGT
GTGATGTGTATTCAACCTTTAGCAATCATATACATAAGGGTTTCTTCAAA
AAAAAAAAAAAAAAAAAAAAAAAA > SEQ ID NO:44 25159_300074_1 *Arabidopsis thaliana*, antisense
TCTTTCTTCTTCCTGATTGGAATTTTAGGGCTTTTGAAAGCACGAACGCG
TGAAGCTCTAATCGAGAAAAAAATGGAGGTTTTGGATAGGAGAGACGATG
AGATCAGGGACTCGGGAAACATGGACAGCATCAAGTCACACTATGTTACC
GACTCTGTTTCCGAGGAACGCCGCTCTCGTGAGCTCAAGGATGGTCTCCA
TCCTTTACGGTACAAGTTTTCGATATGGTACACTCGTCGCACACCAGGGG
TTCGGAACCAGTCTTATGAAGATAACATCAAGAAGATGGTAGAATTCAGC
ACGGTTGAAGGATTTTGGGCCTGCTACTGTCACCTTGCTCGTTCTTCTCT
CTTGCCTAGTCCAACAGATCTTCATTTCTTTAAGGATGGGATTCGTCCAT
TGTGGGAGGATGGTGCCAACTGCAATGGAGGAAAGTGGATCATACGTTTC
TCAAAAGTTGTATCTGCTCGCTTCTGGGAGGATCTGCTTCTTGCGTTGGT
AGGCGACCAGCTTGATGATGCTGATAACATATGTGGGGCAGTACTGAGTG
TCCGTTTCAACGAGGACATCATTAGTGTATGGAATCGCAATGCTTCTGAC
CATCAGGCAGTGATGGGTTTGAGAGACTCAATCAAGCGGCATTTGAAGTT
GCCTCATGCATATGTCATGGAATACAAGCCACACGATGCTTCTCTCCGCG
ACAACTCTTCCTACAGAAACACATGGCTGAGAGGATAGGCCCAAAGTCGA
TGATTGTATCATGTAATGTGGAGAAGATTTGGAAGCTCATCTGCAACCT
GGGAAGATATCTGGATTGAACCCTGTATCCAATACCATACTGTACCGGAG
GCTTACAATATCAGAAAACAAAATCCGGGCTACTTCTGTGTCAGTATGT
GTTCATTTCGTTTTTCTTTTACAGTACATCTTGTTAACTTCAATGGTTTG

Figure 1m

ACTCTTGATCAAAACTATAAGGGTTAATTTTCA

> SEQ ID NO:45  25160_300074_1  Arabidopsis thaliana, antisense
AAAGACGCTGAAGAAGAACTTTGCCAACAAGGGTCTTAACGCTAAAGACC
TTGTGGTTCTCTCAGGGGGTCACACCATTGGAATCTCTAGTTGCGCTCTC
GTCAACAGTCGTCTCTACAACTTCACAGGAAAGGGCGATTCTGACCCATC
CATGAACCCTAGCTACGTGAGGGAATTGAAGAGAAAGTGCCCGCCTACAG
ATTTCAGAACCTCACTGAACATGGACCCAGGCAGTGCGTTGACATTCGAC
ACTCACTACTTCAAGGTCGTGGCTCAGAAGAAAGGGCTCTTCACATCTGA
CTCTACGCTTCTCGATGACATTGAGACCAAAAACTACGTTCAGACTCAGG
CCATTCTCCCTCCTGTGTTTTCTTCTTTCAATAAAGATTTCTCCGATTCC
ATGGTCAAACTTGGTTTCGTCCAAATTCTTACCGGCAAAAATGGTGAGAT
CAGGAAGAGATGCGCCTTCCCTAACTAATTTGGATCGATCAGACCGGGTT
TCGGATGATTTTGAGTCTACACGTTTTTCTCTGCTTATTTTCTTTCTTTT
TCTTTTTTCTTTCACGGAAGTTTGAGCTTTGGTGTTGTCTTCTTCTGTTT
CTTCCATGAATAATTGTTTTTTGTTGAGTAACTTTACATTTGTATTCTTT
ACGGTGACTGTGTTTTGTAATGGAAAAAGTTTGTTTCGAATTC > SEQ ID NO:46  25164_300074_1  Arabidopsis thaliana, antisense
TGTAACCATGCCTTCTCTCTACGAAAAATCGGAACTTTTCTCTGTCACAG
AGAATTTTCTAAATCCGAGATTCACCTGGACCATTCGGGGATTCTCTACG
CTGCTAAAAAACAGTTACCTATCAGAAGTGTTCTCCATCGGAGGAAGAAG
TTGGAATATACAAATCAATCCAAGTGGTCTTGGTACGGGAGAGGGAAAAG
CTTTGTCGATGTATCTTGGCCTTAATGTGAATGAGATATTCAGACCATAT
GAGAAGATTTATGTTCGAGCCAAGCTTCGAGCTCTTAACCAACTCAATCT
CAGTAACATCGAAAGGGAACTCGATATTTGGTACAATGGTCCGGGATATG
GAGAATATAGCTGGGGTTTCCCTGAGTTTATCTATTTCCCTTATCTCACA
GATTCATCAAGGGTTTCGTTAAGAACGATGTGTTGATGGTTCAAGTTGA
AATGGAGGCCATTTCTTCAACCAAGTACTTCCCGAGTTAGATTTTCTCTA
AGCAAAGAACTTGTACCTACCTCCATGTGTTTGATTTGTTATCAAATACT
AATAAGAATTTGATTATGCATTTCAAATACAATTGTTTCTTTTTCTTAAA
AAAA > SEQ ID NO:47  25168_300074_1  Arabidopsis thaliana, antisense
TTTTTTTTGTTATAAGAAAGACCGATTGATTTATATGTAACACCAAAACA
ACATAGAGAAAACCAAAAGGAACAAGCAAGAGCTTCCCACGGCAGACATT
CTAGAAGGATGATTTACTCAAAGATATCATCATCGTCATCGGGGAGGGGT
TGAG > SEQ ID NO:48  25170_300074_1  Arabidopsis thaliana, antisense
GAAGAAGCAGCTGAAGCTGCTAAATCTGCTTGAAAAAACCCGCTATTGAT
TTATGGTCTCTTCCTTGTTGTTTCCTCGAGATGTTGTTAATCTCTGTTAT
TTGTTGCTGAACCATCTTGTATTTGTTTTTCTTTTGGTGTAAACACTTTC
CTTATCAAGTAA > SEQ ID NO:49  25176_300390_1  Arabidopsis thaliana, antisense
TTTTTTAAAATTTAAAAACATATTTTCAAATCAATGTAAAATAGAAACGT
TGAAGAGAGAAACAACTGAAGAATGGGGGCAAAGCGCCAGAAACTTGTAA
AAACAAGTAAAAGGATTGGCAAAAGTAAGAAAGCACACCACTTTAAAACT
AACATTAAGCTTTGGATGATGATGATTCTTCTTCGTCATCTTCATCAATG
TCCCAACTTAAATCTTCATCTTCCT > SEQ ID NO:50  25180_300074_1  Arabidopsis thaliana, antisense
TGAAACCGGAAATGTAGTAACTTGACATAAGTTTTTCAATCCGACAATAA
AAGTGATCCGAGTTCGAATCTATCAAAAACCAAACGACAAAAACTAATCA
CGACGACATAGCGTTGTTGACTACAAACAGTTACAACATCCTACTTTGAT
AGAGATTGTGGATCCACTCTTATCACTCGTCAGCTGGTGGCGAACGAGGA
GACCGGCTCTTCTGCATTGGGCTCTCTGCACCATCATACCCACCATCACT
GTCTCTTCTTCCTATTGACCCAGGGCTTTCAACTTGGCCATTCTCGGGGC
TAGACCTCGATCTCTCTCTCCTTTCAATGGGACTTTCAACTTCACCAACC
CCATTCTCGGACTCTCCTTCTTGAACGGGCTGTGATTAGGGCTCATCCT
CTCTCTCTTGTTGTTGGGACTGCGGCTGTACTTAGTAGGGCTTGCGACTC
TCTCCCTCCTGCGAGGGCTATCATTGCCTCTGCGGTCACGACCATACTCG
GGACTGCCACGTCTTGATTTCTTGTAAGGACTTGGGCTACGTCTTCGACC

Figure 1n

```
ATAGTCAGGACTGGTCCTTTCCTTTCTGTAGGCAGCAACAGGACTAGCTC
CTCGGCCATAATCAGGGCTTCCTCTTTCTCTTTTGTAAGGACTAGGTGAT
CGCCTTCTCCTTTCAGGTGACCTATCACGGCGTCTTTCAGGACTGTGTCC
ATTTCCTCTAGCATCATCATCCTTCACAGCATACTCCACCGAGATCACCT
TATCCATCAGCTTACTGTTATTTGAAGCATCCAATGCTCTGGTGGCATCC
TCTTGTGCCTCGTACTGGATAAATGCAAAATTCCTCCTGATCCTAACGTT
TACGATCTTTCCATACGGCTCAAAGTGTTTCTCTAGATCCGGGTCCTAG
TATTATCCGCATCAAAGTTAATCACAAAGAGAGTCTTGGAAGGTCTCATG
CTGGATGAGGATCTCCTTGAACCACCACCAGATCTTTTATCACCTCCACG
TTCACTCTTTGTCCATTCAACACGAAGTCTGCGTCCCTTACGCCCAAATT
CAAAGCGGTCAAGTGCTCGGATGGCATCTTCCGCATCCCTTTCATCTTCC
ATGTATACAAAAGCAAACCCAGCTTTCATATCAACCCTCTCAACCTTGCC
GTATTTCCTGAATAGTCGTTCCAGGTCACCTTCGCGCGCATCATACTCAA
AGTTCCCACAGAAGACTGGCTTCATGCTTCCTGTAGAATGATTTTGGCAG
GCGTAGTCGCG
> SEQ ID NO:51  25182_300074_1  Arabidopsis thaliana, antisense
ACGATAACTCCGCCGTCTCCCGCCGTCTTGCTCTCACTCTCCTCGTCGGC
GCCTGCTGTTGGTTCCAAAGTATCTCCTGCTGATGCCGCCTACGGTGAAG
CTGCAAACGTGTTTGGGAAGCCAAAGACGAACACAGACTTCTTGCCATAC
AATGGAGATGGGTTCAAAGTGCAGGTTCCAGCAAAATGGAACCCAAGCAA
AGAGATTGAGTATCCAGGACAAGTCCTTAGGTTCGAAGACAACTTCGATG
CTACTAGCAATCTCAATGTCATGGTCACTCCTACCGACAAGAAGTCCATC
ACTGATTACGGTTCTCCCGAAGAGTTCCTCTCTCAGGTTAATTACCTCCT
AGGGAAACAAGCTTACTTCGGTGAGACTGCCTCTGAGGGAGGCTTTGACA
ACAATGCAGTGGCAACAGCAAACATTCTGGAGTCATCATCTCAGGAAGTT
GGTGGGAAACCCTACTATTACTTGTCTGTGTTGACAAGAACGGCTGATGG
AGACGAAGGTGGGAAGCATCAGCTGATCACAGCAACCGTGAATGGAGGGA
AGCTTTACATCTGCAAAGCACAAGCTGGAGACAAGAGGTGGTTCAAGGGA
GCCAGGAAATTTGTCGAGAGCGCAGCCACTTCTTTCAGTGTTGCTTGAGT
GAAAGCAACACAACGTAACAATGCTCTGCTTGCTTTCTTCATTTGTCTCT
TGTAAAAAATGGAAAATGAAACTGAGCTTTTGAGAAAAAAAAAA
> SEQ ID NO:52  25195_300074_1  Arabidopsis thaliana, antisense
GATATGAGTAGCCAAATCGCTTTGTCACCGGCCATCGCCGCCGCCATTCG
CCGTCCGTCCTCTCACGACTGTCTATCCGCTTCCGCCACTACTGCTACCG
CCACCCCCATGGCTCTCAAATCTTGCATCGTCGCACCTCTCTCGCTATTC
ACCTCTCAATCTCAAATCAAACACTCAAGCTCAAGAAAAACTTCTCGAAC
CACGATTCGATGCGATGTAGCGATAAAATCCGCAGATTCGATAAACGCAG
ACGCCAATCCTTCGTCCTCACCGTCATCAGAGGAAGAAATCGAAGCGGAA
GCGAAGGCGAAGATAGGATCTAGGGTTAGAGTAACTGCACCGTTGAAGGT
TTATCATGTAAATCGAGTTCCAGAGGTTGATTTAGAAGGTATGGAAGGTA
AACTCAAAGATTACGTTGCTGTTTGGAAAGGGAAACGAATCTCAGCTAAT
CTTCCTTATAAGATTGAGTTCTTCAAAGAAATTGAAGGTCGTGGTCTTGT
TAAATTTGTTTCACATCTTAAGGAAGATGAGTTCGAGTTCATTGATCAGT
GATGAAACAAGAAAGACAATTTTTGTTTTCCTTTCTCAGTGTTTGTTTTT
GTTTGTTGTGTTACTGGAACCTGGGAATGGAGAATGATTTGTATGTAGT
GTGATGTGTATTCAACCTTTAGCAATCATATACATAAGGGTTTCTTCAAA
AAAAAAAAAAAAAAAAAAAAAAA
> SEQ ID NO:53  25196_300074_1  Arabidopsis thaliana, antisense
GATATGAGTAGCCAAATCGCTTTGTCACCGGCCATCGCCGCCGCCATTCG
CCGTCCGTCCTCTCACGACTGTCTATCCGCTTCCGCCACTACTGCTACCG
CCACCCCCATGGCTCTCAAATCTTGCATCGTCGCACCTCTCTCGCTATTC
ACCTCTCAATCTCAAATCAAACACTCAAGCTCAAGAAAAACTTCTCGAAC
CACGATTCGATGCGATGTAGCGATAAAATCCGCAGATTCGATAAACGCAG
ACGCCAATCCTTCGTCCTCACCGTCATCAGAGGAAGAAATCGAAGCGGAA
GCGAAGGCGAAGATAGGATCTAGGGTTAGAGTAACTGCACCGTTGAAGGT
TTATCATGTAAATCGAGTTCCAGAGGTTGATTTAGAAGGTATGGAAGGTA
AACTCAAAGATTACGTTGCTGTTTGGAAAGGGAAACGAATCTCAGCTAAT
CTTCCTTATAAGATTGAGTTCTTCAAAGAAATTGAAGGTCGTGGTCTTGT
```

Figure 1o

```
TAAATTTGTTTCACATCTTAAGGAAGATGAGTTCGAGTTCATTGATCAGT
GATGAAACAAGAAAGACAATTTTTGTTTTCCTTTCTCAGTGTTTGTTTTT
GTTTGTTGTGTTTACTGGAACCTGGGAATGGAGAATGATTTGTATGTAGT
GTGATGTGTATTCAACCTTTAGCAATCATATACATAAGGGTTTCTTCAAA
AAAAAAAAAAAAAAAAAAAAAAAAA
```

> SEQ ID NO:54  25405_300074_1  *Arabidopsis thaliana*, antisense

```
AGTAAACGAGCAAAAGAAGAAGAGAAACAACAAGAAGTAGTAATGGCTTC
CTCTATGCTCTCCTCCGCCGCTGTGGTTACATCCCCGGCTCAGGCCACCA
TGGTCGCTCCATTCACCGGCTTGAAGTCATCCGCTGCATTCCCGGTCACC
CGCAAGACCAACAAGGACATCACTTCCATCGCAAGCAACGGGGGAAGAGT
TAGCTGCATGAAGGTGTGGCCACCAATTGGAAAGAAGAAGTTTGAGACTC
TATCTTACCTCCCTGACCTTAGTGACGTCGAATTGGCTAAGGAAGTTGAC
TACCTTCTCCGCAACAAGTGGATTCCTTGTGTTGAATTCGAGTTAGAGCA
CGGATTTGTGTACCGTGAGCACGGAAACACTCCCGGATACTACGATGGAC
GGTACTGGACAATGTGGAAGCTTCCATTGTTCGGATGCACCGACTCCGCT
CAAGTGTTGAAGGAAGTTGAAGAATGCAAGAAGGAGTACCCGGGCGCCTT
CATTAGGATCATCGGATTCGACAACACCCGTCAAGTCCAATGCATCAGTT
TCATTGCCTACAAGCCCCCAAGCTTCACCGAAGCTTAATTTCTTTTCTAA
AACATTCTTATGAATTATCTCTGCTCATTTCATTTCCTATTGTCTGTGTT
CTTTTTCTCTTTATGAGACAATTTCTATCGGATTGTCAAATGTCTGATTT
ATGAATATGTAATTTATATAAAAA
```

> SEQ ID NO:55  25414_300074_1  *Arabidopsis thaliana*, antisense

```
AGCCAGGAGAATACTCTCCTATGCCACATCATTCGTCTTTATCGACCAGT
ATGGGACCATCATCGTACGAAGGCAGAGAGCGGAAGAGCAGTAGTATGAT
TCAACACGGAGGTTATCTTGAAGAGCCAAGCATCAGACTTCTTGGAAAAG
AAGCTTCCAGCAAAATGGCTCGTCGTGATCCTGACCCAATCTATGACCGT
GAATGGGAAGACGACAAGAGGAGAGCAGAAAGGAAGCGGAGAGATCGGAA
GTAGAGAGTGATGATTTGCAGATCCTTTGGTTTGTTCAACGAAGAGAGAG
ACAAATACTGGTATTGAACACTGCTTATGTTGTACACGTACTATTCAATG
ACCGTGCGGGTCTACTTTGTCATTTGGCTCCGCCGAGTTTGATAAATGAC
TTGCCAGACTTCAGAT
```

> SEQ ID NO:56  25421_300074_1  *Arabidopsis thaliana*, antisense

```
AATCTTTGTTGTTGTAAGATGTTATAAGGATCTCAAGCACCTATTATTCT
TAAATATTATTGGTTGATGTTGCTAGCAAGAAAAATTGAATACAACCTTA
AAAAAAAAAAAAAAAAAAAAAAAAAAAAAAAAAAAAAAAAAAAA
```

> SEQ ID NO:57  25425_300074_1  *Arabidopsis thaliana*, antisense

```
GAGATGGCTGCATCGCATAACCGGAAGCTTGTTCAACCTCCCGAAGGAAC
TTTCTTCTAATACTCTCAAAGCCTACCTTTGAGGGCTTCTCCATTGTTG
GTCTTCAAGCTTTTCTTTCGTACCTTAAAGTAAAAACAATGGTGTCTGTC
GATGAATGATGATGTTCGATTGATCATCTGGAGTTTAAATCCTTGTGTGC
AAATATATCTAGACAACGCTGTCTCACGACTTCATCTTCTCAGTTTAGAT
ATAATATGGGAAACAACCTTCTAGAAAAAAAAAAAAAAAAAAAAAAAA
```

> SEQ ID NO:58  25427_300074_1  *Arabidopsis thaliana*, antisense

```
TTTTTAGAGAGTCAAATTAGAATCTTGTTTCAAATACCATCTTCAAATGC
AAGAGATAGTAAGAGAGCTCAAAAGGTTAAACCAAGAAAGTAAAATGACA
TTATTAAGGTCGACGAGAATGTACAATCATCAAGAGGATCAGACGTAGAA
GCTGAGGTAATTAGCAGTAGAAAGATCCACCAAATGTGTTCTCTCCACTG
TATGTCATGTAGAGAAACCCGTCTTCGTCTTTGTGTTCTTCGTAGATTGC
AGACATCAATGCCGCAGTTGGTGGTAATGTGTTCTTGACAAAGACAAAGA
TGGCTTTTTCAGCTCCAAGCTTGATTCTTTTCCTCACAACGTACACAAAT
TGGCCAATGGTTAGATCAGCTGGTACAAGATACTTCTTCTTGTCAATGTC
AGGAACATCACTCTGTCCAGCTTTTCCACAATCACGGGAACTCTTTCAGG
```

> SEQ ID NO:59  25431_300074_1  *Arabidopsis thaliana*, antisense

```
CTATAGAGAATCTTCAAGCATTAGAAGGATTTGTGAATCAAGCAGATCAT
CTGAGGCAACAAACTTTGCAACAAATGGCGAAGATCTTAACGACAAGACA
ATCGGCTCGAGGTTTACTAGCTTTAGGAGAGTATCTTCATAGACTTCGTG
CTCTTAGTTCTCTTTGGGCAGCTCGTCCACAAGAACCAACTTAAAAGAGG
```

Figure 1p

```
AACTTATTAAAACTTTAAAAACAAGAAACAGCAGAATCAAAAGTCTTGAA
GAAGCATACTCATCACAAAGCTTGGAAGGATGTTTTAAAAAAGATCTTTG
TTAATTAAGTAGAGTGAGATTCTCTTGATTAGAACTTTATGGTTTTTGCT
TTATGAAGTATCTCTCCAGAGAAGATTGTAAATTTGGGTTGAAACTTTGT
AATATATTTAGATACAACAAATAAGTTTG
```

> SEQ ID NO:60  25437_300074_1  *Arabidopsis thaliana*, antisense

```
TTTTTTTGCGTAATGTAGTTTCCTACGTTGTTGTATCTATAAATAGTTTG
TTTCTCGAGCTTCCATTTCATAATTCCTCATTTCCCGGATCTCTCCCATC
TAAAAATAACCCGACCCATTTACGCGACCCAAACCGGATCAACCCGCAAT
GGATAAGCCAAGCTTCGTAATCCAATCCAAAGAAGCAGAATCCGCCGCGA
AACAACTCGGCGTTTCCGTCATTCAGCTCCTCCCGTCGCTAGTCAAACCA
GCACAATCCTACGCTCGAACTCCGATTTCGAAATTCAACGTCGCAGTCGT
CGGACTCGGATCATCAGGTCGGATCTTCTTAGGCGTCAATGTCGAATTCC
CAAATCTCCCTCTCCACCACTCAATCCACGCCGAACAGTTCCTCGTCACC
AATCTCACACTCAACGGTGAACGTCACCTCAATTTCTTCGCCGTCTCCGC
CGCACCATGTGGCCATTGCCGTCAATTCCTCCAAGAAATTCGCGACGCAC
CTGAAATCAAAATCCTTATCACCGATCCAAACAACTCCGCCGATTCCGAT
TCCGCCGCCGATTCAGACGGATTCTTACGTCTCGGAAGCTTCTTGCCACA
CAGATTCGGTCCCGACGATCTTCTCGGGAAGATCATCCTCTTCTTCTCG
AATCTCACGATAACCATCTCAAAATCTCAGATCTGGATTCGATTTGTAAC
GGAAACACCGATTCATCCGCCGATTTGAAACAAACGGCTTTAGCGGCGGC
GAATAGATCGTACGCGCCGTATAGTTTATGTCCATCGGGAGTTTCGCTGG
TGGATTGTGACGGGAAAGTGTACAGAGGTTGGTATATGGAATCGGCGGCG
TATAATCCTAGTATGGGACCAGTACAGGCGGCGTTGGTTGATTATGTGGC
TAATGGTGGTGGAGGAGGATACGAGAGGATCGTCGGAGCGGTTCTGGTGG
AGAAAGAAGATGCGGTGGTGAGGCAAGAGCACACGGCGAGGTTGTTATTA
GAGACTATATCG
```

> SEQ ID NO:61  25450_300074_1  *Arabidopsis thaliana*, antisense

```
CAAACATCAGAAGCCCTAGAGCTTGAGCCGTCGAAAATGTCGAAGCGAGG
ACGTGGAGGAACGTCTGGTAACAAATTCAGGATGTCACTTGGTCTGCCCG
TTGCAGCCACAGTGAACTGTGCAGACAACACTGGTGCTAAGAACCTTTAC
ATCATCTCTGTTAAAGGAATCAAAGGTCGTCTCAATCGGTTACCTTCTGC
TTGTGTTGGTGACATGGTTATGGCCACTGTCAAGAAAGGTAAACCAGACC
TCAGGAAAAAGGTTCTTCCTGCTGTGATTGTTAGGCAACGTAAGCCATGG
CGCCGAAAGGACGGTGTTTTCATGTACTTTGAAGATAATGCTGGAGTGAT
TGTGAACCCTAAGGGAGAAATGAAAGGTTCTGCAATTACTGGACCTATTG
GGAAGAGTGTGCGGATCTCTGGCCAAGGATTGCTAGTGCTGCTAACGCC
ATTGTCTGAAGATCATTTATCACTTTTGCTGGTTATGTATCTGTCTTCAA
CGAAACGCGAAATAGTTGGTGTTTTGAGTGTTTTAAGTAGAGACGACAAT
CTTTTGTGAGCTTCAGACATATTTCCAGTTTCTAAGAGATTTTGCTTAGA
TTAAA
```

> SEQ ID NO:62  25459_300074_1  *Arabidopsis thaliana*, antisense

```
TTTTTTTTTTTTTCCAACCACAACGAGATGAATTACACCACGACTCTAAG
TGAAATCATCTTTTAAACCACCAAAATTCACCCAATGACACGAAAACATT
TCTAGCACAAAGAAAATCAAATCCTATCCTGAGATCCAATCCAATTCCAA
GCTATTAGTCCCTCATGATCCGAGTGTAGAACATGTCCTAATAGCATCTA
CGCCAAAAGCGCAACTTCAGAAGGGTTTTGACTCCTCTGCTTTCACTATT
TCGGTCCTAAGCCTAAAACGGACATACTAATCCGACTGATACTCAACCGG
ATCAACCGGGCTGAGACAAAAATTTCTTGAAGTCGAGGCTTTATTGGAGA
GCTTTCCTTCTTCTTCTACAATCCAAATGGTTTTCTTTTCTCCCCCATTT
CTCATTAATTCTCCATCAGGAGTCGTTGACGGCAGCATAGCTAATACGCC
TTGAATCATGTAAATCTGCCCGGGATCGATAGGATCTTCACAACCAAGCT
CGAAAACCACGATCCGCCTACCTCTGTACCTTCTTAACACTGAGCCACCA
CTACCAAGGAGGTTCATCGGAGGAGAGGTACCTCCGCGAAGAGACTGACG
AAGAAATCCACCAGATCTGCTGCCGTCGTCGAGAGTCATAGTTCCCCATT
GTAGATCTACCAACGAACCTCCATCTGAGAGAACTATCTCCGCTCGCCGT
CGACTTAAAACTCTTTGATTAAGCCACAAAGAAGGAGGAGCCGCCGCCGG
CTAAAAAAAATCGACACAAAGGAAAAAAAAAACTAAAAAGAGAAGAGAGG
```

Figure 1q

```
CCCTCTCACGGTGCCGGCCGAAACCGACCACCAAAGAGGCAAAACGGCGT
TTGAAGATTTGATCTGGTTTGCGGCGGCTAACTAGAGAGAGAGAACTAGG
GTTTTTTGTTTAGTT
> SEQ ID NO:63  25466_300074_1  Arabidopsis thaliana, antisense
CTATAGAGAATCTTCAAGCATTAGAAGGATTTGTGAATCAAGCAGATCAT
CTGAGGCAACAAACTTTGCAACAAATGGCGAAGATCTTAACGACAAGACA
ATCGGCTCGAGGTTTACTAGCTTTAGGAGAGTATCTTCATAGACTTCGTG
CTCTTAGTTCTCTTTGGGCAGCTCGTCCACAAGAACCAACTTAAAAGAGG
AACTTATTAAAACTTTAAAAACAAGAAACAGCAGAATCAAAAGTCTTGAA
GAAGCATACTCATCACAAAGCTTGGAAGGATGTTTTAAAAAAGATCTTTG
TTAATTAAGTAGAGTGAGATTCTCTTGATTAGAACTTTATGGTTTTTGCT
TTATGAAGTATCTCTCCAGAGAAGATTGTAAATTTGGGTTGAAACTTTGT
AATATATTTAGATACAACAAATAAGTTTG
> SEQ ID NO:64  25687_300076_1  Arabidopsis thaliana, antisense
TTTTTTTTTTTTTTTTTTTTTTTGAGGAGAAATAATTGGTAAACTTT
TGCGGTACATACGGTTTGGGTCAAGTTACAAACGGATAAACCGGTATAGA
ATACACAGAGTTTTTGAATTCTCCCATTTAAGCTGCAACTTCTTCGACCT
CATCCAATGCATAGTTGTTGGTCGATATGTTGGCGTAATTGACTTTTGCG
AACCGGACCACAACCGGGTATCGAGTCTTAGGGTCCTGATCAACGGCAAC
AACTGATCCAACGTTCTTGAACCAATAGGATTCTCTCCTTAGAATCTTGA
CCTTAGACCCTCTCTTAGGACCAATCGGTGGTGGCTTGGGTTTGGTGGCA
GTAGCTCCATCCGGAGCAGCGGCAGCTGCCGGAGAATCTTTTGAAGAAGA
GGAAGCCGGAGCAGGATCTTCGGCTGCCCTGACTACGAGCCTAGAACCGG
CGTTTCTCATCGGCAAGAAAGACACGGAGCTCCTGGACGACGAAGCGCCG
GCGACCGAGGTGACATTGGCCGGTAGAACAAATACCGTAGATGCTGTCGT
CATCGCCATCTCTGGTTTTCTTTT
> SEQ ID NO:65  27402_300076_1  Arabidopsis thaliana, antisense
AGTTACATCGAGTAACGCAGCAACATTTGGGGTCGGGGCTATTCAGGTAG
TAGCGACTGCAATATCCACTTGGTTGGTGGACAAAGCAGGTCGTCGGCTT
CTGCTTACTATCTCTTCGGTTGGGATGACGATTAGCCTTGTAATTGTTGC
AGCTGCTTTCTATCTTAAGGAATTTGTGTCTCCTGATTCAGACATGTACA
GTTGGCTGAGCATATTGTCAGTAGTTGGAGTTGTGGCAATGGTTGTCTTT
TTCTCATTGGGAATGGGACCAATACCGTGGCTCATTATGTCTGAGATCCT
TCCTGTGAACATAAAGGGTTTAGCTGGAAGTATTGCAACTCTAGCCAATT
GGTTCTTTTCTTGGTTGATCACCATGACAGCAAATTTGCTGTTAGCCTGG
AGCAGTGGAGGAACTTTCACTCTGTATGGATTGGTTTGTGCATTCACAGT
GGTGTTCGTGACTCTATGGGTTCCTGAGACCAAAGGCAAAACTCTTGAAG
AACTTCAATCCTTGTTCAGATGAACAAATTGAAACAACTTCATTCTTTGT
CACCCTCTCTCTCCCTCTCTGTTTTGGCCAAGAACAAGAAGAAACAAGAG
ATTTTCCAGCTTTGTTAATTGGGCTGAGAACGTTACTAAGATTTGTTTGT
TTGTTCGTTGTGTGTCAATAATCGCATTATCTTCTATCACATGTATATCA
ACATACTACATTCAAGTATTTGTAATTTTATTGAACTCTTTACATAGAGC
AAAGGTTTTGCCAAAAAAAAAAAAAAAAA
> SEQ ID NO:66  27410_300076_1  Arabidopsis thaliana, antisense
GAACATTCAGAACAAGAACTCATCCTACTTTGTGGAATGGATCCCAAACA
ACGTCAAGTCCAGTGTCTGTGATATTGCACCAAAGGGTTTGAAAATGGCG
TCTACTTTCATTGGTAACTCAACCTCAATCCAGGAGATGTTTAGGCGTGT
GAGCGAACAGTTCACAGCTATGTTCAGGAGAAAGGCTTTCCTTCATTGGT
ACACAGGAGAAGGCATGGACGAGATGGAGTTCACTGAAGCAGAGAGTAAC
ATGAATGATCTTGTCGCAGAGTACCAGCAGTACCAAGATGCTACAGCCGG
AGAGGAAGAGTACGAGGAGGAAGAAGAGGAGTACGAGACTTAAGATGTTG
TCAATGGCTCCCTCGGATTCGTAAGCTGTGTAAGCAAGCAGCATTCACTT
TCTTCTTTCCCCTTATCCTGAATTTTTTTCTTCGTAATATCTCTTTTATT
GTTTCGTTCATGTGTGTTCGTTTTTGTTATTGAAACCCTATATCGGTTCT
GGATTTGTTAAACTTTTGCGTGTATTGCTTATTGTTTTGTCGGTGAAAA
AAATATTGCTTTTGTTCTCTTAAGTTTTGTGTTGCCAAAAAAAAAAAAA
AAAAAAAAAAAAAAAAAAAAAAAAAAAAAAAAAAA
```

Figure 1r

> SEQ ID NO:67 27414_300076_1  Arabidopsis thaliana, antisense
TTTTTTTTCAGCCCAAAGAACACTTTTTAATTACTAGTAAAGTTTAACTA
ACGGTTAATAAACTTACATCAGACAATATTACACTTTTTATCTTGGCTGC
TTCAATGTCTCCGCATCGTTCGTTTTACCGGTGAAAGAAGCTTCTTAGCT
TTCCTCTTTCAAGCTTCTCGAGAAGCTTATCGGCGCCCATTACTTCCATC
TCCGACAGCTTCTTCAGATACCCTATTGCTCCGTACGACACCATCATTTT
CTTACTCTTCTCGCTTCCCGACATCCCCAACAGCCCCGCCACGGCGTACT
TCTTCGCCGTGTTTCCAGGGTTTGAATCCAATAACATCACCAAATTCGTC
AGAACGCTCTTCCCGTCTTTCTTCAGTTCCCGTCGAATCCTTCCTTCCGC
TACCAATCCAGCGATCGCCTGAGCCGCCGCTTCTCGACATCCGTTTGACT
TCGATTCCAGAAGTTTCACGATCTCCGGGATGCAACCGGATTCTCCCACT
AGC
> SEQ ID NO:68 27415_300076_1  Arabidopsis thaliana, antisense
TTTTTTTTCAGCCCAAAGAACACTTTTTAATTACTAGTAAAGTTTAACTA
ACGGTTAATAAACTTACATCAGACAATATTACACTTTTTATCTTGGCTGC
TTCAATGTCTCCGCATCGTTCGTTTTACCGGTGAAAGAAGCTTCTTAGCT
TTCCTCTTTCAAGCTTCTCGAGAAGCTTATCGGCGCCCATTACTTCCATC
TCCGACAGCTTCTTCAGATACCCTATTGCTCCGTACGACACCATCATTTT
CTTACTCTTCTCGCTTCCCGACATCCCCAACAGCCCCGCCACGGCGTACT
TCTTCGCCGTGTTTCCAGGGTTTGAATCCAATAACATCACCAAATTCGTC
AGAACGCTCTTCCCGTCTTTCTTCAGTTCCCGTCGAATCCTTCCTTCCGC
TACCAATCCAGCGATCGCCTGAGCCGCCGCTTCTCGACATCCGTTTGACT
TCGATTCCAGAAGTTTCACGATCTCCGGGATGCAACCGGATTCTCCCACT
AGC
> SEQ ID NO:69 27424_300076_1  Arabidopsis thaliana, antisense
GATTCGATAAGAAGAATCTACATGGCTCGACATATCATGGAGAAGTTCAT
CGTCGCAGGAGCGGAAATGGAATTGAACTTATCTCATAAAACCCGACAAG
AGATCTTAACCACTCAAGATCTAACTCACACTGATCTCTTCAAGAACGCA
TTAAACGAAGTCATGCAATTGATCAAGATGAACTTGGTAAGAGATTACTG
GTCATCCATCTACTTCATCAAGTTCAAAGAAGAAGAAAGCTGCCACGAGG
CAATGCATAAGGAAGGATACAGTTTTTCATCTCCAAGACTGAGTTCAGTT
CAAGGCTCTGATGATCCTTTCTATCAAGAACATATGTCAAAGAGTTCCAG
ATGCAGTAGTCCCGGTTAAGGAGTCTAAAACTGGTACTAGACCAGAACCC
AAACCAATGTTCATAGCAATCCAATCCATGTAATCTTCCTTCACATTTCT
TGTACATGTCATTTTCTCTCTTGTTATACCTAACTGTAAGAGAAAATGTC
CGGTTCGGATTTTGGTTTAGTTTTAAATGTGTATACCGGACAAAAACTAT
GGAACCATACTAATTAATATCTCGAAGA
> SEQ ID NO:70 27430_300076_1  Arabidopsis thaliana, antisense
TGGGTTTTTGTTTTGAACTCTCCTTATGTATTACCGCCTCGCCGGAGACT
GATACAGTTTCTTCTGTCCCTCATTGAAAGAAGAAAAGAAAACAAAAATA
GAAAAAAAAGAAAGCAGAAAAAAAGCCTAGGAGGAACAATGAATTTAGA
AAACCAAACCATGACAGAAAAGTCTGCGGGATTCTCTGGTTAGCTCTAGG
TGATGATATGATCAAGTTTCGTCCTCACTGGCTTTGTATGAAGGGAAAAG
AAGATAATCTAAAAGATTCGCCAAAAGACACAGATCGTTCACCGTGATGG
CTCGCCTACAATATCGTGGTAAAACAAAAACGATTGTACTAAGTAGCAAT
TCCTCTGTTTGGTTGTCTCTTGTTCACACTGTAACTGCCAACATAACCTG
GAGATGAACTTCTAGCTGAAACATCTGAAGAAGGAACCCCTCCTCCAATC
CCATAGCTAAAAGGAGCAGGCCCTTCTGTCTCAGGAGTTGGTGATCTCCA
TGTAGGGTCACTATAAACTGCACCATTCCCGTAAAACTCTGCAAGTCCTG
CTGTATCATAACCCGTGTTGTTGGTTGCTGAGGCAGAAGAGAATGAAGAG
GATGGTGCTGCCTTGTTAGCCCCTGGGTTTCTTGCTGCATAACCACCTGT
TCCCAACCCAAAACCAGATTCACCGTTTC
> SEQ ID NO:71 27440_300076_1  Arabidopsis thaliana, antisense
CTCGGTGAGGCTGTCGGTGTTGAAGGGCTGGTTGTCGGTCTGCGCGCTCA
GCGCCAGCAGCGCGCGCCGCGAGAAGCAGGTACCGACACCGGCCGACGGC
ACCATGCCGGAAACACTTTCGCGCACCACCAGATCCTTGGCATGCCATTC
GGCGAACTCGTCCATGTAGACGCCGGCCACCAGTTCGTACCACTCGCGGT
CCAGCGAGGTGACCGGCAACTGGATCATGTCCTTGCGCGGCAAAAGGTAG

Figure 1s

```
TTGTAGAAGCGCAGTTCCATCGGGTGCAGCACGTCCTCGCTGTCGTGCAG
GATCACCCCGGCGAACTCGATGTCGTGGCGCTTCTCGTAATCGAAGATGG
CCAGGATCAGCCAGTTCAGGCAGTCGGCCTTGCTGGTCGGCCCGTCATGC
GGCACTTCCACGCGGCGCAGGCGCTTGTAGCGGCGGCGCATGCGCTCCAC
TTCGTCGATGGTCTGCTGGTCGTTGGGATAGGTGCCGACGAACACGACGT
ACTCGCGGTAATCGAGTACGTTGATCATGTTCTCCACCATCTGCGCGATG
ACGTCGTACTCCATCCACGCCGGCACCATGATCGCCAGCGGCTGTTGCG
```

> SEQ ID NO:72 27441_300076_1 Arabidopsis thaliana, antisense

```
TTGATTTAAAAACAGTTGGTGGAAAGCTTACTTTGTACCAAACGACCCTA
TGCGAGAGAATCTCAGGGGATAACATTGATCTCGGGCTAGATCTCGGGTC
TCAAAGCTTTTTGCCAACATACAACAAAATGACATCCAGCTGATATGCT
GTCAAGCTGATGCAAGTGTTTTATGGCTTGTCCCTGACACAGTTGTGACC
AGATTTATTCAATCCCTTGACTGGGACACAGATATGGACATCACCTTTAC
TTGGGTTCTTAACAGAGACCGCCCTAAAGGCAAGGAGACTGTGAAATATG
AAAGAAGTGTCGACCCTCTGGACCTTCCAAAACGCTCTGATATCCAAATG
GTTCTCAATGGGTCGATGGATGGATTTAGAGTGCATAATTTGTACCCAAA
GTTCTTCCGTGTTACTGGTTCTGGTGATGTCAGGTCTTTCGAGGATCAGA
CGGATGAAGTGAGTGCAGACATACTCATTAACCATGCAAATTTCAAGTGG
TGGTGGTCATTCCATAATCTTAAAGCGTCTGAAAATATCAGCGCTTGCGA
GGGGATGGATGGACCAGTTGCTATCATAATGTCTGAGGAAACACCGCCAC
AGGGCTTTCTGGGTGACACCCTCAGCAAGTTCAGTATATGGGGACTCTAT
ATCACATTTGTACTAGCGGTGGGGCGTTTCATCAGGCTTCAATGCTCTGA
CCTGCGTATGAGAATACCTTACGAGAACCTGCCTTCGTGTGACAGATTAA
TAGCCATATGCGAGGACTTGTACGCGGCTAGAGCAGAGGGTGAGCTTGGA
GTAGAAGAAGTTCTATACTGGACGCTTGTGAAGATCTATAGATCCCCGCA
CATGCTGCTCAGTATACAAAGCTAGACTATGATGCTTAGGTCCAAAACC
AGTCTCTCACACTAAAGAAACACTTTGTCATATTTGTACATACTGAGCGG
AATATTCTGAGGGATTTGTTTTGTTTTCAATCAGCTTGTAGTTGATT
```

> SEQ ID NO:73 27459_300076_1 Arabidopsis thaliana, antisense

```
ACGATGTTGATCACAAGGGGCAAGAGATGGTAACAACAGTTTGCATGAAA
TGCCACATGCTGGTTATGTTGTGTACATCAACTCCTGTTTGTCCCAACTG
CAAGTTCATGCACCCACACGATCACAGCTCTACAAAACTGTTTAAACCAT
CAAATTTGCTTAGGCTTCTATGCTAGGCTCTTTCAAGGTTACTGAATCTA
TAAAATTTGTACGGCAGATAATAAGCCAAGAGACTAGATATGGACAAAGT
TATGTATATACTAAAAGTACCAGAAAGTTTGTATTAATTCTCTGCTTCTA
TGAACGATCATGCTTTAGATCTCTAAAAA
```

> SEQ ID NO:74 27460_300076_1 Arabidopsis thaliana, antisense

```
CGCTCGCGATCTAGAACTAGGCTTTTACGAACAGAGAGCGAGCCAGAGAG
AGTGAGTAAGAGAGAATGACGAGCGTGAGTGGGTGTGGTTCAGTGAGTCT
GATAACTAACCGCAGTGCGTTCTTGGGAAACGGACTTCAACACCGTGCCG
TTTTCCTTAAACCATGGTCGTCTTCTTCGCTTCAGTCTCGGTCCATGGTT
GTCGAAGCCAAAACCAAAACCAGCAGCGAAGACAGAATCGCCCGCCACTC
TCGTATCCGTAAGAAGGTTAATGGTACAACGGAGAGGCCAAGGCTATGTG
TTTTCCGATCAAACAAGCATCTTTATGTTCAAGTGATTGATGATACCAAG
ATGCACACCTTAGCTTCAGCTTCCACTAAGCAGAAACCAATCTCTGAAGA
GTTCGACTACACCTCTGGACCAACCATTGAGGTAGCGAAGAAAGTTGGGG
AAGTGATAGCAAAATCTTGCTTGGAGAAAGGTATCACAAAGGTAGCCTTT
GACCGTGGTGGTTACCCTTACCATGGACGTATTGAGGCTCTTGCTG
```

> SEQ ID NO:75 27461_300254_1 Arabidopsis thaliana, antisense

```
TTTTTATTAATAGTTATTTTATTAAATTTTGAAGTACTATTTTTGTCAAT
ACAAAAATTCTGCAACACATTCTGCTTCAGGAAGAATGAAATCAGTCTCC
CAACAAACAAGTTCTTTACGAATACCAAGGGGAGTGTCGGACTGATGTTA
GCCAAGTTGATTTTTTTTTCATCAAGAAACTAAATGCTTTCTCTGAGTT
TGACAGGAAGGTCAAGATCAGGTTCCGTGGGAGTCAAGGCACAGAAGTAA
TCATCAACCATGTCCTCTGATACTTTCTCCAAGCTCGGTGGATCCCACTT
TGGTGCTTCATCCTTGTCTATCAATCGAGCTCGTACTCCCTCACAAAAAT
TGCCGGACATTGGCCCGATTAATCCTTGTAGCGACATTCTGTACTCTCGG
ATTAAGCATTGGTCAAGTGTTTGTAATCTTCCTTCCCGGATCTGTTGGAT
```

Figure 1t

```
TCGTTTTAAAGAAGAGATCTCAATGCCACCTTCAAAGATAACGGTGAGCT
TTCTTTAAGTCTACGTAGAGTCGTAATGCACCATGTATCTTTTCTTCTAC
TAGCCTCGATTTCCAAAGAATCAATAATTTCTTCTACTGTGTCATGGCTA
AAGCATTTTTCAAGTAAATCGATCCTACGAATAACACCAGTCTTTTCCGG
ATGGGCAACTTCTGCACATTTTTCTAAG
```

> SEQ ID NO:76  27468_300076_1  *Arabidopsis thaliana*, antisense
```
AGTTAAATGGTTTGGGATTTAAGAAAGTTTTCTTCTTATAACAGAGTTGG
TAAATTTAAAATACAACGGAATATAATCGAAACAATCAGTGAAACTATAG
AGATATATTGATCACTTTTCAATTTTTCATGACCCAAAACCTCTCAATTT
CTCCAGCGGTTCTTCCTGGGATCCTCCCAGCTATCAGTTCCCACCTTTCA
TCAAATAATAACACACAAAATTCAGCTTTTACTATGGTGTTACAATTAAA
TTATTTTCCTACGAAATAGTATTCATTATTAGTTAAAAGATCAAACCTGT
CACCGACAAGCTTATGCATTCGAGAGACCAAATCTTCTTCTTCTTGACTC
ATGTTCACAACTTCCCACTCAAGACTACTCACTTCTGTTCCTTGTCATCA
CCAAAATTCAGATTTCTCATTATATATAGATAAGTATAAAAAAACATGGA
AAAATGAGAAAACGAAGGTGTTTAAGTTTTCAGCTTACCTTCAGAAGAAG
AAGTAACGATGGAGTTGGTCTTGGGTTGCTTAGTCCTGCGATGGTTATCC
ATGTCAAACGGCACCGTATTACAAAGAAGAAGAAGAAACTAAGAGA
GTACTCTGAGAGAG
```

> SEQ ID NO:77  27475_300076_1  *Arabidopsis thaliana*, antisense
```
GATTCGATAAGAAGAATCTACATGGCTCGACATATCATGGAGAAGTTCAT
CGTCGCAGGAGCGGAAATGGAATTGAACTTATCTCATAAAACCCGACAAG
AGATCTTAACCACTCAAGATCTAACTCACACTGATCTCTTCAAGAACGCA
TTAAACGAAGTCATGCAATTGATCAAGATGAACTTGGTAAGAGATTACTG
GTCATCCATCTACTTCATCAAGTTCAAAGAAGAAGAAAGCTGCCACGAGG
CAATGCATAAGGAAGGATACAGTTTTTCATCTCCAAGACTGAGTTCAGTT
CAAGGCTCTGATGATCCTTTCTATCAAGAACATATGTCAAAGAGTTCCAG
ATGCAGTAGTCCCGGTTAAGGAGTCTAAAACTGGTACTAGACCAGAACCC
AAACCAATGTTCATAGCAATCCAATCCATGTAATCTTCCTTCACATTTCT
TGTACATGTCATTTTCTCTCTTGTTATACCTAACTGTAAGAGAAAATGTC
CGGTTCGGATTTTGGTTTAGTTTTAAATGTGTATACCGGACAAAAACTAT
GGAACCATACTAATTAATATCTCGAAGA
```

> SEQ ID NO:78  27481_300076_1  *Arabidopsis thaliana*, antisense
```
TATAGAAATTATGCGTACGCTACAATCAATGGCATTACAATGAACCAACC
TGGTATTCAGATTTTACCAAATGACAATGGACAGAAAAAATATACAATTT
TGAACAGATCAGATGCAAAAGTTGTTCTACAGACAGAAAAAGGGTAAGAC
TTGATGCATCTTGTTGAGGAGTTTGGGAAGATGATGATGATGATGATCGG
TAGGAGTAGGTGGATCTGAGTTCTTGTCTTTCTTTTTTCTCCTAAGCTGG
AAAAACTGCTGCATTGTCTGAGCGCATTCTGATTCAAGAACTCCGCGCCG
GATTGTCATCTTAGGATGGAATGGATGAACTGGAGGTGGTGGCTTTTCTG
AAGCCTCTGATCCATTTCCTTCGCCTCCAGGGAACAGCCTGATCCAGCTT
CCATCTGCTCCGAGAAGCTTATTGGGAGCACCCCATGCAAGAGTGTTGAC
CCTTGCTTGAAGTATTGCTCCCGCACACATTGGGCACGGTTCTAGTGTTA
CATAGAGCGTTGTATCCGCGAGCCTCCATGAACGAAGTGCTTTAGAACCC
TCTCGAATGCAAATCATTTCTGCATGGGCAGTTGAATCACGAAGCTCCTC
TACTAGGTTATAACCACGGGCAATAATCTTTCCATCATGAACAAGCACAG
CACCGACAGGTACCTCCC
```

> SEQ ID NO:79  27819_300076_1  *Arabidopsis thaliana*, antisense
```
CTTCATCAAATCTCACAAATCTTCAACACTTAATCACAAATCTCAAAGCT
TCGGATACCAAATGGCTCGTACCAAGCAAACCGCAAGGAAATCCACCGGA
GGAAAAGCCCCAAGGAAACAACTCGCAACAAAGGCGGCGAGGAAATCAGC
TCCGGCGACCGGAGGAGTAAAGAAGCCACACAGATTCCGTCCTGGAACTG
TTGCCCTAAGAGAAATCAGGAAGTATCAGAAGAGCACTGAGCTTCTGATC
CGCAAGCTTCCGTTCCAGCGTTTGGTTCGTGAGATCGCTCAGGATTTCAA
AACAGATCTGCGTTTCCAGAGCAGCGCCGTCGCAGCACTTCAGGAAGCGG
CTGAAGCATACCTCGTTGGATTGTTTGAAGACACCAATCTTTGCGCGATT
CATGCTAAGAGAGTCACTATCATGCCTAAGGATATTCAATTGGCGAGGAG
AATTAGAGGCGAGAGGGCTTAAGAAGGAGATTGAAGTACTCTAGACTGTG
```

Figure 1u

ATCGTTATGCTTATGTATATCTTTCGTTTTCCCTAATTTCGTGTTTTAGG
GTTGGATTAGGTTTTGCGTTTATGTTGTTCGATATCTAACGGATCAAAAT
CTCTCCTTCCTTAGCAAAGTTTGAAAACTCCCTCCACATTTTCAAAAAAA
AAAAAAAAAAAAAAAAAAAAAAAAAAAAAAAA

> SEQ ID NO:80  27864_300076_1  *Nicotiana benthamiana*, antisense

CGAGCTTCGACTTCGAGCTGTGGAAAGTCTGCCGTGCCACGTCAGCAACA
CCAAGCCTCTTCAAGCCGTTCAGTGTAGTGTCGGTGGACGGGAAACCTC
ATGCTCAGCCGTAGACGGCGGTTTGGTGATGAACAATCCAACAGCAGCTG
CCGTCACGCACGTGCTACACAACAAACGAGATTTCCCGTCAGTAAACGGC
GTAGATGACTTGCTTGTACTGTCGTTGGGAAACGGTCCGTCGACCATGTC
ATCATCACCAGGGAGGAAACTCCGTCGTAACGGAGACTATTCAACGTCAA
GTGTGGTGGACATAGTGGTTGACGGCGTTTCCGATACCGTCGATCAGATG
CTGGGGAACGCTTTCTGCTGGAACCGTACTGATTACGTTAGAATCCAGGC
GAACGGTTTGACGAGCGGCGGAGCGGAGGAGTTGCTGAAAGAGAGAGGTG
TGGAAACGGCGCCGTTTGGGGTAAAACGGATACTAACGGAGAGTAACGGA
GAAAGAATAGAGGGTTTCGTGCAACGTCTTGTTGCGTCAGGAAAGTCAAG
TCTACCTCCAAGTCCTTGCAAGGAATCTGCCGTTAACCCTCTCGCTGACG
GCCGTTAAGTTTCCTTTATTATTATAACCCTCCCCGTCCGTGATGTAAGA
AGTTTGTAACCAAACCCCTGGGTTAATTTTTTAACCCCAGCCAGCATCTT
CGAGTTAATTAATTAGCCTTTCTTTTTTTCTAATGACTTTAGTTGAGGAA
TTAATAATGGTTAATGAATGATAGTCTTTACTTATTTATCCAAAAAAAAA
AAAAAAAAA

> SEQ ID NO:81  29267_300160_1  *Arabidopsis thaliana*, antisense

AGGCCACCAGGAGTAACTTGGGATGGCCTTATGAGCCTTTCCACGTGCCT
GAAGATGTCAAGAGCCATTGGAGTCGTCATGTTCCCGAGGGTGCTGCTCT
TGAAGCTGGATGGAATACCAAGTTTGCTGAATATGAGAAGAAGTACCCAG
AGGAAGCTGCAGAACTCAAATCCATTGTCACTGGTGAACTACCTGCTGGC
TGGGAGAAAGCTCTGCCTACCTACACACCTGAAAGTCCAGCAGATGCCAC
CAGAAACC

> SEQ ID NO:82  29949_300076_1  *Arabidopsis thaliana*, antisense

TCTCCTTGGAATGTCCAAGCTTGATAATTCTCTTGCTTATCTCTTCTTCT
CCCGCTAGGGGCTCTGATTCATTGTCTGCGGACGCGTGGGTCGACCCGGG
AATTCCGGACCGGTACCTGCAGCCATTGGAGCTCTGCTGTTAATTGAAGA
CAAGATCAAGACAAGAGGAGTCTTAAGGCCTCTCGAAGCAGAGGTGTATT
TGCCAGCTTTGGATATATTGCAAGCATATGGTATAAAGCTGATGGAGAAG
GCAGAATGATCAAAGAACTCTGTATATTGTTTCTCTCTATAACTTGGAGT
TGGAGACAAAGCTGAAGAAGACAGAGACATTAGACCAGCAAAAAAAAAAA
AAAAAA

> SEQ ID NO:83  30087_300076_1  *Arabidopsis thaliana*, antisense

CTTCTTCAGGGTTCAGGTGTGAAAGCTGACGCCACCGTGGCAGCTGACGG
TAGCGGTACATTTAAAACTGTGGCTGCTGCGGTTGCCGCGGCCCCTGAAA
ATAGTAATAAGAGGTATGTGATACATATAAAAGCCGGAGTTTACAGAGAG
AATGTGGAGGTTGCTAAGAAGAAAAAGAATATAATGTTTATGGGAGATGG
TCGGACGAGAACTATTATCACCGGAAGTCGAAACGTTGTAGACGGTAGCA
CCACTTTCCACTCCGCCACCGTTGCTGCTGTCGGCGAGAGATTCTTAGCT
CGTGACATCACTTTCCAAAACACGGCGGGTCCGTCGAAGCACCAAGCGGT
GGCTCTCCGTGTGGGTTCTGATTTCTCCGCCTTCTACAATTGCGACATGT
TAGCTTATCAAGACACTCTATACGTCCACTCTAACCGTCAATTCTTCGTC
AAATGTCTCATCGCCGGAACCGTTGACTTCATCTTCGGAAACGCCGCCGT
CGTGCTCCAAGACTGTGACATCCACGCTCGCCGCCCTAATTCCGGTCAGA
AAAACATGGTCACAGCTCAGGGAAGAACGGATCCTAACCAGAACACAGGG
ATCGTTATCCAGAAATGTAGGATCGGTGCCACGTCGGATTTACAGTCGGT
GAAAGGTAGTTTTCCGACGTACTTGGGTCGGCCATGGAAGGAATATTCAC
·AAACGGTGATAATGCAGTCGGCTATCTCCGACGTGATCCGACCCGAAGGG
TGGTCCGAGTGGACCGGGACTTTTGCGTTGAACACTCTGACTTACAGAGA
GTATTCGAACACAGGAGCAGGGGCTGGAACTGCAAATAGAGTGAAGTGGA
GGGGCTTTAAGGTAATTACGGCTGCTGCTGAAGCTCAAAAATATACGGCT
GGTCAGTTTATTGGTGGTGGAGGCTGGTTATCGTCGACCGGTTTCCCCTT

Figure 1v

```
CTCGCTCGGTCTTTGAGAGATTGTTGTGTAATGTGTTCCTACGTATTGTT
GGCTACAAAAATTATTGATTAATATTGTATGAAGCAAATCGTGTTGTCCT
CTTTGTTTTGTTTGGGTTGTGTACTTTCTCTAGATCATCGTAGTATTAGA
AACGAGATGAAAA
> SEQ ID NO:84   30307_300076_1   Arabidopsis thaliana, antisense
CAGGCAAACAAGACCAAGAGGAAGAAGAAGAAGAAAAAGAGAAAAGGCCC
TGTGATGGACAAACCCATGAGTGTAGACTGGTTTGTTAGGGAAACTTGTA
GACGCCTCAAGGAGAAGAAGTCTTACATGATATACACAGCTGTTGGGTGT
CTCGGAATTGCTGCCTTAAGTGATCTTGTCAATGAGGTGGTAGCAATTGA
GACCTGTGGAGGTCAGGTGACTGCTGATGGCACTAGGAAACGGACAAGTG
GTGGTGTATTGTGGAACATCATCAAAGCGAGACAGCCTGAAGCTTATAGA
GAGATAATGAAAAAGACCAAGGAGTTTGAGAAACAATTTAGGCAACCAAA
CACGAGACCAAAATCAGGGCCCAAAAGAGATCAGGGTAGCTCCTCCGAAG
GAGTTGCCTCTGGAAATGTATCTGCTGATGAAGCTCTGGTGAGCGAGATG
TGTGTTATGCCGGTAGCTGACCAGACTGAATCCAAACCGGAAAAGGAAAG
GAAATCTGTTCATGAGAGGATCAGGGTACCTGTTTCATATGATGACCTTT
TCAGAGATGCACCTTTAGATGATTCTCTAGCACATCATTCTTCTGCTTAA
GCTCATTACTGGATGACTTCTCTTGTGGAAAGCAATTGTTTTGTCGAGAA
ATGGAAAGCATTGATTTTGTCGAGAAATGCATTGACAAAACTATATATAC
CAACTACCAAGATTTCTTAAATACACAA
> SEQ ID NO:85   30310_300076_1   Arabidopsis thaliana, antisense
GAGAAGGCACTTCCTACATATACACCAGACTCTCCGTTTGATGCCACCAC
ATACCTGTCTCAGCAATGTCTTAACGCACTTGCGAAAGCTGTGCCTGGTT
TTCTTGGTGGGAGTGCTGACCTTGCATCTTCCAACATGACAATGCTTAAA
GCATTCGGCAACTTCCAAAAAGCCACACCTGAAGAAAGAAACCTTAGATT
TGGTGTCAGGGAACATGGTATGGGAGCTATCTGCAACGGCATTGCCCTTC
ACAGCCCCGGTTTTATCCCTTACTGCGCAACTTTCTTTGTGTTTACTGAC
TATATGAGAGCTGCAATGAGAATCTCGGCTTTGTCTGAAGCTGGTGTTAT
ATACGTTATGACCCATGACTCCATTGGTCTTGGAGAAGATGGACCAACCC
ACCAACCCATCGAACACTTATCCAGTTTCCGTGCCATGCCCAATATTATG
ATGTTCCGTCCAGCTGATGGGAACGAAACAGCCGGTGCATACAAAATCGC
TGTCACAAAACGTAAGACACCTTCTGTCTTAGCCTTATCTAGACAAAAGC
TGCCTCAACTTCCAGGAACATCTATTGAGAGCGTCGAGAAAGGTGGATAC
ACCATTTCTTGACAACTCAACCGGTAACAAACCCGATGTGATCTTGATCG
GAACTGGATCAGAGCTAGAGATTGCTGCTCAA
> SEQ ID NO:86   30880_300077_1   Arabidopsis thaliana, antisense
CAAGAACATTCTCAGCTTCTAGAAGGTTTTCTCACCAACCCCCAAATTAT
GAGAAAATTACGAAATTGGCTAACCAACTACAAAAGAATGATTCAATTCA
CCAAACGAATTAAATGAAGCATTAAATTGAGAGTAAATGAGTTTTCGTTA
GAGTGAAACTCACGTAAGTGTTGAGCTGACGAATGAAGCTTGAGAAATTA
TTATGCTTGAAGTATTGAGGAAGAAGATCTTTAGCAAACTCTGCTGTTTT
CCACACGACAAAAGCTGTTCCTTCTTCGTTCCATGAAACGACGTCGTCTG
TGCTATGATCATCAACTAGCTGATACGTTTTGCTTAAAAACGGCGCCGGA
ACTGATCTTTGCGCCGCCGTCACAGCCGTCATCTCCGGCGAACTTTTTTT
ATTTTACCACAGAAAATAAAACTAAAAATAATCTAATACACAAAGAGAA
GAAGAAAGATTGGAAATAGAAAGTCGAAGGAAAAAGAATCAGCAACTAAA
AAGCAAGAGAGCGGTGAGAAATTCCCAATCCCAGCAATAAAAGCCAGAGA
GGAAAACACGAGAACGGAGAAGATCGGAGTTTCGTTTGGTTTCTTCCATT
TAAGGAAAAATCTGATGATGGAGGAAGAAGATGAAGACGACGACCATACT
TCGCCGGAGCTAATCCGTGTGATTAAAAAGTAAATAAATATAAAGTCTTT
TTTATTTTTGTGTGTATGTGCAAAACAAGTAAAACAAATATATAAACGAG
TTAAGTGTTATGTCGAAGGGTCTCTATATAACGTAGTAGGAAGATTTATA
GATCACAAATGTTGGTCCTACCTTTGTAAGAAAATTAAATTATAAAAACG
GATGCTGTTTCTAGAAAAAAA
> SEQ ID NO:87   30913_300077_1   Arabidopsis thaliana, antisense
GCTGCAGATATCAAAAGGATCTTCACCTAGATCCTTTTAAATTAAAAAT
GAAGTTTTAGCACGTGTCAGTCCTGCTCCTCGGCCACGAAGTGCACGCAG
TTGCCGGCCGGGTCGCGCAGGGCGAACTCCCGCCCCCACGGCTGCTCGCC
```

Figure 1v

```
GATCTCGGTCATGGCCGGCCCGGAGGCGTCCCGGAAGTTCGTGGACACGA
CCTCCGACCACTCGGCGTACAGCTCGTCCAGGCCGCGCACCCACACCCAG
GCCAGGGTGTTGTCCGGCACCACCTGGTCCTGGACCGCGCTGATGAACAG
GGTCACGTCGTCCCGGACCACACCGGCGAAGTCGTCCTCCACGAAGTCCC
GGGAGAACCCGAGCCGGTCGGTCCAGAACTCGACCGCTCCGGCGACGTCG
CGCGCGGTGAGCACCGGAACGGCACTGGTCAACTTGGCCATGGTGGCCCT
CCTCACGTGCTATTATTGAAGCATTTATCAGGGTTATTGTCTCATGAGCG
GATACATATTTGAATGTATTTAGAAAAATAAACAAATAGGGGTTCCGCGC
ACATTTCCCCGAAAAGTGCCACCTGATGCGGTGTGAAATACCGCACAGAT
GCGTAAGGAGAAAATACCGCATCAGGCGAAATTGTAAAGATATC
```

> SEQ ID NO:88  34133_300077_1  *Arabidopsis thaliana*, antisense

```
AGTCCTTCGGTTTTTGCTGGCTGGTGAAGCGTGTTGTCGAAGAGAGAAAT
CTCAAGCTGTTGCTGGTCCTGGTCATAGTGTAGCAGTCACATCGAAAGGA
GAAGTTTATACTTTCGGATATAATAACTCTGGACAGCTAGGACATGGTCA
TACCGAGGACGAAGCTCGAATTCAACCTGTTAGATCATTGCAGGGAGTTC
GAATCATCCAAGCAGCTGCTGGTGCTGCTCGGACAATGCTAATAAGCGAT
GACGGAAAAGTTTATGCGTGTGGAAAAGAATCCTTCGGGAAGCTGAATA
CGGAGGGCAAGGGACTAAACCAGTTACAACTCCTCAGCTTGTAACATCTT
TAAAAAACATATTTGTAGTGCAAGCAGCTATTGGGAATTACTTTACCGCT
GTTCTCTCCCGAGAAGGAAAGGTTTATACATTCTCGTGGGCAATGACGG
TAGACTAGGACACCAAACTGAGGCTGCGGATGTCGAGCCTCGTCCTTTGT
TAGGCCCACTCGAGAATGTACCCGTTGTGCAGATTGCTGCTGGTTATTGC
TACCTTCTTGCCTTAGCCTGTCAACCAAATGGCATGTCTGTTTACTCAGT
TGGTTGCGGTTTGGGAGGCAAACTTGGTCATGGGTCAAGAACAGATGAGA
AGTATCCTCGGGTCATCGAGCAGTTTCAGATATTGAATCTTCAACCTAGG
GTAGTTGCAGCGGGTGCTTGGCATGCCGCGGTGGTAGGTCAGGATGGAAG
AGTGTGCACTTGGGGTTGGGGAAGATAATGATGT
```

> SEQ ID NO:89  34136_300077_1  *Arabidopsis thaliana*, antisense

```
GAAGAAGTTCCGTATAACATCTCCATTATTCAGATCAGTAGAGTTTTACC
GTCGGAGACTGCGGCGGCTCCGACTCCTGCTCCGGCGGAGATGAATCTTA
CCGGAATAATGTCGGCTCATGGATGCAAAGTGTTTGCTGAGACTCTTCTC
ACTAACCCTGGAGCTTCAAAAACCTATCAGGAGAGTTTAGAAGGAGGCAT
GACAGTGTTCTGTCCAGGAGATGATGCAATGAAAGGTTTCTTGCCCAAAT
ACAAGAACTTGACAGCTCCAAAGAAAGAAGCATTTCTCGATTTCCTCGCT
GTCCCGACATATTACTCAATGGCGATGCCAAATCCAACAATGGTCCGATG
AACACACTTGCGACAGATGGAGCTAACAAGTTTGAGCTTACTGTACAGAA
CGATGGAGAGAAGGTTACCCTCAAGACAAGGATCAACACTGTCAAGATCG
TTGATACTCTTATTGATGAGCAGCCTTTAGCTATATATGCGACTGATAAG
GTTTTGTTGCCTAAAGAGTTGTTTAAGGCTTCGGCTGTTGAAGCTCCGGC
TCCTGCTCCGGCACCAGAGGATGGTGATGTTGCGGATTCTCCAAAAGCGG
CTAAAGGGAAAGCGAAAGGAAAGAAGAAGAAGGCTGCACCGTCGCCAGAT
AATGATCCTTTTGGTGACTCGGATTCGCCTGCCGAAGGGCCTGACGGAGA
GGCCGATGATGCGACGGCAGATGATGCTGGTGCGGTTAGGATCATCGGAG
GAGCTAAGGCTGGTTTGGTGGTGAGCTTGCTCTGCTTGTTTGCTTCTTCT
TGGCTTCTATAGTTTCACTTCTTGTTTCTTCGATTCTTCCATGTTTTTTT
TTTTTTGTGAATCTTTTATTTATGGTTTTTGGGGGAGAGTAAATGAGGAT
TATTTATTTCCCTCTATTGTTGAGTTTTTTTTATTTATTTAAAAGTTGGT
TGTCGAATTAAA
```

> SEQ ID NO:90  34406_300077_1  *Arabidopsis thaliana*, antisense

```
GGACAAGGAAGGAATCCCTCCGGATCAGCAGAGACTTATCTTTGCCGGTA
AGCAGCTTGAAGACGGAAGAACTCTTGCTGACTACAACATTCAAAAGGAG
TCGACCCTTCATTTGGTGCTTCGTCTCAGAGGTGGTATGCAAATCTTTGT
CAAGACCCTCACTGGTAAAACAATCACCCTTGAGGTTGAGAGTTCAGACA
CCATTGACAATGTCAAAGCTAAGATCCAAGATAAAGAGGGAATTCCTCCG
GATCAGCAGAGGCTTATCTTTGCCGGTAAGCAGCTCGAAGATGGACGCAC
CCTTGCAGATTACAACATCCAAAAGGAGTCGACACTTCATCTTGTGCTTC
GTCTCCGTGGTGGTATGCAGATCTTTGTGAAGACCCTTACCGGAAAGACC
ATTACTCTGGAGGTTGAAAGCTCAGACACCATCGATAATGTCAAGGCTAA
```

Figure 1x

```
GATTCAGGACAAGGAAGGGATCCCACCAGACCAACAGAGACTCATCTTCG
CTGGAAAACAGCTTGAGGATGGTCGCACACTTGCAGATTACAACATCCAG
AAGGAGTCGACTCTTCACTTGGTTCTTCGTCTTCGTGGTGGAAGCTTCTA
AGCTTTTTGTGATCTGATGATAAGTGGTTGGTTCGTGTCTCATGCACTTG
GGAGGTGATCTATTTCACCTGGTGTAGTTTGTGTTTCCGTCAGTTGGAAA
AACTTATCCCTATCGATTTCGTTTTCATTTTCTGCTTTTCTTTTATGTAC
CTTCGTTTGGGCTTGTAACGGGCCTTTGTATTTCAACTCTCAATAATAAT
CCAAGTGCATGTTAAACAAAAAAAAAAAAAAAAAA
```

> SEQ ID NO:91 34415_300077_1 *Arabidopsis thaliana*, antisense
```
ATACAAACACTAGAAGTCTTATAAATTCAAAGTATGTCTGAGTTTTACAA
CATTAGAGAGAAAGAGAACAACACAGAAACATTTATAGAAACATGATTAC
ACATGCGCTAACAACTTTAAGATTTACTGAGCCAAAGCACTTGTGTTGTA
CACAAGAAGAGCACCTCCGGCAAGAATTCCGGCGAGAGTTACCGCCCAAA
TTGCCAATCCGGTGACTCCTCCCTTGTACACGTCACCACTCGCTGACCAC
TCGTTCTCGTTGTAAATAGGACTGTATCCATCGACGTTAGCTCCATACTT
GTCGACGTACTTGTAAACACCGTATCCCTTGCCCTTTCTGCCGGAGGCGT
CGACGCCGTCCCTCAAGTCCATGCTGCCGTTAATTCCGAAGGGCTTGTCG
GTCTTGATCTTCTTGACGCCACTGGCGACAATTTTGAAGGAGGGACGAGC
TCTTGTGAGCGACGGTAATCCTCTAGCCGCCGTCTTCTCCACCGTGAAAC
CAGCTGGTTTCAATGTCACCGAAGATAGCATCACTGAAGCAGCCATTATT
TTTCTCACAAGATGATCAAACTATTCTTCTC
```

> SEQ ID NO:92 34442_300077_1 *Arabidopsis thaliana*, antisense
```
TTTAATGCTTTTCTAATCAATAAATATCAAATTATCCACCAGATAAAAAT
AATAATTTAAAAAGCGTATTCTCAAATCGTAACAAAAAGGGATATTTTTG
GTGTTTGTCACCCAAAAGTATAACCTATCCAATGAGGGTATGAAGAAAAT
TGAGTGAATCAAAATATAAAGATAAAAAAAAGGGAAGACGAAGCAAAAC
TCTTTTGTATGTTTCTTCTCATTAGCAAAGGCTGGGGTAAAACTTAGAAG
TTGACTTGAAAGCCACTGCGTCTGCGATGACCTGCACCGCCTTTTGATCT
GTTTGAGTTTCTTTCATATTGGTATCGCATCCCCAAACCCTTACCGCAAG
CCTACGACATTTGGGTGATGATTCTCTGAAATAGGTTTTGTACCAACTGA
TCACATCTTTCTTCTGTATACTTCTTAGTTCTTCTGCTTCTTTGTGGGAG
AAATCAAACATGTACCTTTTGTCAACAATCTGACTCCATAAGTCATTTGT
CTCGGACAAGAGAGAGGGATCCTTTTCCAGCAATCTAGCAATCATACCAC
TTCGGTAATCTTCATAGGATTCATCATCCAGTTGTTCCAGAAGCCCTTCG
ATATCTTTTATGAAATTGTCAACTCTCCCCAGCAAATGAACTGGACCGTA
CTTAGAAGATTGAACACAGAAACAGAAACCGTGCACACGATACGTTAAGC
GAGGGCCACACTCGACAACATAACCAAGCTGCTCCTTTGTCCTCAACTGA
TTGAACAATGGCTCTTCTATGATTTCATGAAAGAGATCCAGCACAGCTTT
CGTTCTCGTTGATTGAGCTTCTTCAGGCTCGATTTGATAGTAAAGCTCGA
CTACTGAGTTTGTTTCAGATTTGTTCTTCACATT
```

> SEQ ID NO:93 34963_300077_1 *Arabidopsis thaliana*, antisense
```
GTAGGGGCAAAACATATTATACCATAAGGACCACAAAACATCACAACAAT
GATATTTTCAACAGAGTACTAGTAGAGTATGTTTATAAGGAGGGATAGGG
AATTTTTTTCAAACATAGAACAGATTCTCTGAGAGAGAATGTTTTCATAA
GAGAGTATTATATAGCTAACTCTGATTTCAGCAGGTCAAGAGAGGAGATG
AACCACTGCATTTGACATCAGAAGCATCAGAAAGGCGTTGTCTTGGAGAG
AGTGTTGTAATCGCTGCAACATCTACGTCGAGATTCACTATGAGCTTCCT
CTTCTGCGACTCTGTTACACTGTTCCTTCTCTCTTCTGATCCTTCAGCAA
TGGGACTCAAAGTCTGTGTCTCTGCTGCTCCAACGTCTTCTCCATCTGCT
GCGTATAGGATTCTTTTTATGGAACCAACAAGAGGTAAGTGCTCTGTGTC
TGGGTTTTGACAGAGAATCTCTACATCTCTGAGTTTAGAGAAATAGAAAT
CTCTCTCTTTCTCTAAGCTGTCAATGTAAAGTTTCAGTTCTGTGATCTTT
TCATCATAAGCAGGCACTGGTTTAGATTGTTTAGCTGATGGTTTTGAAGA
GTGGTGGTGATTCCCAGTTGAAGAATGGTGAGTACCGGTGTTGTTGGATT
GTGGCTCATGCTTACGGGTTCCATTTGAAGATGAAGGTCGAGGTGGAGCT
GAAGAAGACGAACTCTTGCCTGATTGTTGT
```

> SEQ ID NO:94 35526_300493_1 *Arabidopsis thaliana*, antisense
```
AAGAAAAGTAATTCTCTGTTTGTGTAGTTTTCTTTACCGGTGAATTTTCT
```

Figure 1y

```
CTTCGTTTTGTGCTTCAAACGTCACCCAAATCACCAAGATCGATCAAAAT
CGAAACTTAACGTTTCAGAAGATGGTGCAGTACCAGAGATTAATCATCCA
CCATGGAAGAAAAGAAGATAAGTTTAGAGTTTCTTCAGCAGAGGAAAGTG
GTGGAGGTGGTTGTTGCTACTCCAAGAGAGCTAAACAAAAGTTTCGTTGT
CTTCTCTTTCTCTCTATCCTCTCTTGCTGTTTCGTCTTGTCTCCTTATTA
CCTCTTCGGCTTCTCTACTCTCTCCCTCCTAGATTCGTTTCGCAGAGAAA
TCGAAGGTCTTAGCTCTTATGAGCCAGTTATTACCCCTCTGTGCTCAGAA
ATCTCCAATGGAACCATTTGTTGTGACAGAACCGGTTTGAGATCTGATAT
TTGTGTAATGAAAGGTGATGTTCGAACAAACTCTGCTTCTTCCTCAATCT
TCCTCTTCACCTCCTCCACCAATAACAACACAAAACCGGAAAAGATCAAA
CCTTACACTAGAAAATGGGAGACTAGTGTGATGGACACCGTTCAAGAACT
CAACCTCATCACCAAAGATTCCAACAAATCTTCAGATCGTGTATGCGATG
TGTACCATGATGTTCCTGCTGTGTTCTTCTCCACTGGTGGATACACCGGT
AACGTATACCACGAGTTTAACGACGGGATTATCCCTTTGTTTATAACTTC
ACAGCATTACAACAAAAAGTTGTGTTTGTGATCGTCGAGTATCATGACT
GGTGGGAGATGAAGTATGGAGATGTCGTTTCGCAGCTCTCGGATTATCCT
CTGGTTGATTTCAATGGAGATACGAGAACACATTGTTTCAAAGAAGCAAC
CGTTGGATTACGTATTCACGACGAGTTAACTGTGAATTCTTCTTTGGTCA
TTGGGAATCAAACCATTGTTGACTTCAGAAACGTTTTGGATAGGGGTTAC
TCGCATCGTATCCAAAGCTTGACTCAGGAGGAAACAGAGGCGAACGTGAC
CGCACTCGATTTCAAGAAGAAGCCAAAACTGGTGATTCTTTCAAGAAACG
GGTCATCAAGGGCGATATTAAACGAGAATCTTCTCGTGGAGCTAGCAGAG
AAAACAGGGTTCAATGTGGAGGTTCTAAGACCACAAAAGACAACGGAAAT
GGCCAAGATTTATCGTTCGTTGAACACGAGCGATGTAATGATCGGTGTAC
ATGGAGCAGCAATGACTCATTTCCTTTTCTTGAAACCGAAAACCGTTTTC
ATTCAGATCATCCCATTAGGGACGGACTGGGCGGCAGAGACATATTATGG
AGAACCGGCGAAGAAGCTAGGATTGAAGTACGTTGGTTACAAGATTGCGC
CGAAAGAGAGCTCTTTGTATGAAGAATATGGGAAAGATGACCCTGTAATC
CGAGATCCGGATAGTCTAAACGACAAAGGATGGGAATATACGAAGAAAAT
CTATCTACAAGGACAGAACGTGAAGCTTGACTTGAGAAGATTCAGAGAAA
CGTTAACTCGTTCGTATGATTTCTCCATTAGAAGGAGATTTAGAGAAGAT
TACTTGTTACATAGAGAAGATTAAGAATCGTGTGATATTTTTTTTGTAAA
GTTTTGAATGACAATTAAATTTATTTATTTATTAAGTTTTTTTTGGTAA
AAAAAA
```

> SEQ ID NO:95 36415_300077_1 *Arabidopsis thaliana*, antisense

```
AGAAGAAGTTAAAGCAAAACACATACAAACGCAGTCACCTTCTCTGTCGC
CTCCTTCTTCAATCTCATCGCAATCATGATCATATCCGAGACTAATCGCC
GTGAGATCTCCAAGTACCTCTTCAAAGAGGGTGTTTTGTTTGCCAAAAAG
GATTTCAATTTACCACAACATCCTTTGATTGAGAGTGTTCCAAATCTGCA
AGTTATCAAGTTGATGCAGAGTTTCAAATCTAAGGAATATGTGAGAGAGA
CCTTTGCTTGGATGCATTACTACTGGTTCCTCACAAATGAAGGTATTGAC
TTTCTTAGGACTTACCTTAATCTCCCATCTGAGATTGTTCCTGCTACTCT
GAAGAAGCAACAGAAGCCTCTTGGTCGACCTTTTGGAGGTGGTGGTGACC
GTCCCCGTGGCCCTCCTCGTGGTGATGGAGAGAGGAGGTTTGGTGACAGA
GATGGATACCGTGGAGGTCCTAAATCAGGTGGAGAGTATGGTGACAAGGC
TGGAGCACCTGCTGATTACCAGCCTGGCTTCAGGGGTGGAGCTAGTGGAG
CAAGGCAAGGGTTTGGTCGTGGAGCTGGTGGTTTTGGTGGTGGTGCTGGT
CCAGCTGCTGGATCTGATCTACCTTGAAAAGGACTTTCTTGTTTCTTTTT
GGTCTTATTTAAGGTTACATAGCACCTTATTGAGAACGAATGTGTCTTTT
GGAACTTTGTTTCTTTCTCTTAAACCATTTCACAAAA
```

> SEQ ID NO:96 37163_300077_1 *Arabidopsis thaliana*, antisense

```
AGAAAAAGAACAAAAACCTAATTTCAAGAAATTCAATAAATATCATCCTC
CGGATAAGTTGTTATTGTACGTTTACCAAATTCAAGAACAAGAAAAAACT
TTTCCTTTGAAACAAAGAAACATGGATTTCTTCACCGATCAAGTAAAGAA
GAAATTCTCCGACAAGAAACCGGAGAGCTCTGATCCGGAGCCAAACCACA
ACAAAAACAAACCCGGTCACACGGAGCCAACAACACATAAACCCGGTCAC
GGCGAGCCAACAACACATAAACCGGTCTCCAACACCGATCCAACAACACA
CAGACCGGCTACGAACGCTGAGCTCATGGCTAGTGCCAAGATCGTAGCCG
```

Figure 1z

```
AAGCTGCTCAAGCCGCTGCTCGTCACGAGTCAGACAAGCTTGACAAAGCC
AAAGTCGCCGGAGCCACCGCTGATATCTTAGACGCCGCTTCTAGATACGG
TAAGCTCGATGAAAAGAGCGGTGTTGGTCAGTACCTTGAAAAGGCTGAAC
AATATCTTCACAAGTACGAAACTTCCCACTCTCACTCCTCCACCGGTGGA
ACTGGAAGCCACGGTAATGTTGGAGGACACGGTGGTGGAGCTGGAGCACC
GGCGGCTAAGAAAGAAGATGAGAAGTCCGGAGGTGGTCATGGGTTTGGAG
ATTATGCTAAGATGGCTCAAGGTTTTATGAAGTGAGTAATGTTTTAGTTT
CTAAAAATAATTATGTTAGTAATTATCTTCTATAATTACTGTTTTAGTAA
GCTGTTGTTTTTTCTGAATTATTATTAACTGTTGGATTTGTCATTTGTGT
ATGATGGAGGAAATTATGATGTTAAAGATCATGTATCATGTTGTTGACCA
CTCGAGATTGCGTTAATCAAATATTTGTATAATTAGAACCGAACTTTAAG
TTAAAAA
> SEQ ID NO:97 37186_300077_1  Arabidopsis thaliana, antisense
ATACAAGGAAAGTGTTTTGCCATCTGATGTATCAGCTAGAGTTAGTATCG
AAGCTGGATCGACTTTTGGATGGGGAAAGATCGTCGGAGGAAAAGGGAAA
TCGATTGGAATTGATACGTTTGGAGCAAGTGCACCAGCAGGAAAGCTTTA
TAAAGAGTTTGGTATCACCATTGAAGCTATGGTTGAAGCAGCCAAGTCAC
TTATTTAAAAAGTATCTTACAGGTACTACCGAGGTTTGCATTTGAAGTA
AGAGACATTCCATAAGCATTATCTTCTTTGTCCAATAAAAATATACTCC
TTCCAATCTTTTTATAAATGATGTTTAAAGCTTTCATTTTGGTTTTTAAA
TAAATGATGTTTTAAATTTTCAATGCAAAATTATTTTTATTGGTTGATTA
ATAAATGATGTTTTAGGCTTTTATTTATATTTTAAA
> SEQ ID NO:98 37188_300077_1  Arabidopsis thaliana, antisense
CTTGTCAAAGAGAAGTGTGTTTGCGTCATCTTCGATTAGTGTGGGGAAAA
ACTTGGAGGATATGTCAGCGTATATTCATTTCTTGGCGTCTGGATTTGAA
GCTTCCAGAACAGCTTTTGGTGCTATACCTGGAAGCTTGCAGCCCGATGA
AGAGTTATGTAGAGATCTTGGTTTGTCTCTCAACACTCCTTCCCCAAATA
CTCGCAAGCAAGATTGACCTGTTTTTTAATTTATCTTTGTCTGCATATCA
TTGGGATATTTTTGTGTATAAATCAATGTATACTATCTGAATCATTCTAT
AGCAGCTTTGGTGTAATATTGATGATGAAAGTTAGATTTTTCATCTAAAA
AAAAAAAAAAAAAAAAAAAAAAAAAAAAAAAAAAAAAAAAAAAAAAAAAA
AAAAAAAAAAAA
> SEQ ID NO:99 38919_300081_1  Arabidopsis thaliana, sense
TTTTTTTTTTTAAGAAGAAGTTCGACTTGTCATTAGAAAGAAAGAGATAA
CAGGAACGGAAACATAGTAGAACACTTATTCATCAGGGATTATACAAGGC
CCCAAAACACAAACCACCAAAGTTTTACATGAAACGAAACATTGAACTTC
TTAAGCATAACAGAGACGAGATTTAGAAACCACCACGAAGACGCAGGACC
AAGTGAAGAGTAGACTCCTTCTGGATGTTGTAGTCGGCCAAAGTACGTCC
ATCCTCAAGCTGCTTTCCAGCGAAGATGAGACGCTGCTGGTCCGGAGGAA
TACCTTCCTTGTCCTGGATCTTGGCCTTGACGTTGTCAATGGTGTCGGAG
CTTTCCACTTCAAGGGTGATGGTCTTTCCGGTCAAAGTCTTGACGAAGAT
CTGCATACCTCCACGCAGACGCAACACCAAGTGAAGGGTCGACTCCTTCT
GGATGTTGTAATCCGCCAAAGTACGACCATCCTCCAATTGTTTTCCGGCA
AAGATCAACCTCTGCTGGTCCGGAGGGATTCCTTCCTTATCCTGGATCTT
GGCCTTCACGTTGTCAATGGTGTCAGAGCTCTCTACCTCCAAAGTGATAG
TCTTTCCGGTGAGAGTCTTCACGAAGATCTGCATACCTCCACGCAGACGC
AAGACCAAGTGAAGTGTGGACTCCTTCTGAATGTTGTAGTCGGCCAAAGT
TCTTCCATCTTCAAGTTGCTTTCCGGCGAAGATCAATCTCTGCTGGTCCG
GAGGAATACCCTCTTTGTCCTGGATCTTGGCTTTCACGTTATCAATGGTG
TCAGAACTCTCCACCTCCAAAGTGATAGTTTTCCCAGTCAACGTCTTAAC
GAAAATCTGCATACCACCACGGAGCCTGAGAACAAGATGAAGGGTGGACT
CCTTCTGGATATTGTAGTCAGCAAGAGTTCTGCCATCCTCCAACTGCTTT
CCGGCGAAGATCAGCCTCTGCTGGTCCGGAGGAATACCCTCTTTGTCTTG
GATCTTGGCCTTGACGTTGTCGATGGTGTCAGAACTCTCCACCTCAAGAG
TAATCGTCTTTCCCGTTAGGGTTTTAACGAAAATCTGCATACCACCACGG
AGCCTGAGGACCAAGTGGAGGGTGGATTCCTTCTGGATATTGTAATCAGC
CAACGTACGGCCATCCTCTAGCTGCTTGCCGGCGAAAATAAGCCTCTGCT
GATCCGGAGGAATGCCCTCCTTATCCTGGATCTTGGCCTTAACGTTGTCG
```

Figure 1aa

```
ATGGTGTCGGAGCTTTCCACCTCGAGGGTGATTGTCTTTCCGGTGAGAGT
CTTAACAAAGATCTGCATCTTGATCACGGTAGAGAGAATTGAGAGAAAGT
TTTTAAGATTTTGAG
> SEQ ID NO:100  39608_300075_1  Arabidopsis thaliana, antisense
CGTTTGTTTGCAACTCTTGATCCAACTACGAGAAGGGTTCAGATGCAAAA
CGGGAAGGAATTTCTTCTCACAGATACTGTTGGTTTTATCCAAAAGTTAC
CAACCACTCTGGTTGCTGCTTTCAGAGCAACACTTGAAGAAATAGCAGAG
TCAAGCCTTTTGGTGCATGTTGTTGACATCAGCCACCCACTGGCAGAGCA
ACAAATAGAAGCTGTGGAGAAGGTTATGTCTGAACTCGACGTTTCATCAA
TTCCAAAATTGGTCGTGTGGAATAAGGTTGATAGAGTGGATGATCCTCAA
AACGTCAAGCTGGAAGCAGAGGAAACTGGGGATACAATTTGTATATCTGC
TCTGACTGGAGAAGGACTAGACGACTTCTGCAATGCTGTTCATGAGAAGC
TCAAGGATTCAATGGTTTGGGTTGAAGCCCTTTTGCCATTTGATAAAGGG
GACCTTCTAAGCACCATACACAAGGTTGGAATGGTGAAAGAAACTGAATA
TACAGAGAATGGGACACTTATCAGGGCACACGTTCCGCTACGTTTTGCAC
AGCTGCTTAAACCTATGAGACACTTGGTCAAAGATACTTCAATAAGCCAA
AGAGGATGAACCAGAATCATAGCAAGAACCTGAAGGCCTGCCTCTTGGTG
AGAATCGGAGGCTACGTGTGCTTTGCCAAAGCATCCGAAAGCAAAAGGAA
TTCAAACAACCTTCTGATCATACACACCACAAAGAATGACAGTCAGACAG
TAAAGAATATTCGTAGATAAAAAGGAATGCAGCTAGACACAAGCAAGATA
AGCTTGAACCTACTTCACATCGTGAACTGACACTGGAAATGTTATTTCAA
CAGTGATAAGTGATAACCCTTTTTGTAA
> SEQ ID NO:101  42167_300153_1  Nicotiana benthamiana, antisense
CAAAGGAAGAGCTGGACAAAGATCTCATTCAGAAGGCAAGAATATTTCAC
TATGGGTCAATCTCTTTAATCGCGGAACCGTGTAGGTCAGCTCATCTTGC
AGCCATGGAGATTGCCAAAAAAGCTGGCTGCATTCTCTCTTATGACCCAA
ATCTAAGGTTGCCCTTATGGCCATCCGCAGATGCTGCTCGTAAAGGCATC
TTGAGCATTTGGGACCAAGCCGACGTTATTAAGGTAAGCGAAGACGAAAT
CACATTCTTGACAGACGGTGAAGACGCCTA
> SEQ ID NO:102  45801_300075_1  Arabidopsis thaliana
AACATAACATTAAACTGCTTTCACATAGAAAGCAAAAGTCTTAAACAACA
TTACATTAACTCCTTTCACATAAACAGAAAAGTCTTAAACAACATTACAT
AAACTCCTTTCACACAGACACAAAAGGCTCTTTCTTGCTCAACGCATCAA
CACTCTTAGTTCAAGATTTCACCTGTAATGGGTGAAACATGTTGGCTCGT
AGACTTCTGCCCATTTTTTGAACCGACCACTACCATAGGCTTTGGTGGTA
TCAAACCGGCCCTGAAAAGCATGCTTTCCACTGTGTCTGTTGGTTGAGCT
CCAACAGATAACCAGTACTTGATTCTGTCGAATTTGAGGCTCACTCTATC
CGCATCTTCTTTGCCTTGGAGTGGATCATAAAAGCCTAACACCTCGATTT
GTTTACCGTCCCTGCGCGATTTTTCATCGGCGACAACTACACGATAGAAG
GGTCGGTGTTTACAACCAAGACGCGC
> SEQ ID NO:103  45804_300075_1  Arabidopsis thaliana
GATTATGCCCCTCTCGTCACCAAGGCCAAGGGCCGTAAACTCACGGCTGA
GGAACTCTGGTCAGAGCTCGATGCTTCCGCCGCCGACGACTTCTGGGGTT
TCTATTCCACCTCCAAACTCCATCCCACCAACCAAGTTAACGTGAAAGAG
GAGGCAGTGAAGAAGGAGCAGGCAACAGAGCCGGGGAAACGGAGGAAGAG
GAAGAATGTTTATAGAGGGATACGTAAGCGTCCATGGGGAAAATGGGCGG
CTGAGATTCGAGATCCACGAAAGGTGTTAGAGTTTGGCTTGGTACGTTC
AACACGGCGGAGGAAGCTGCCATGGCTTATGATGTTGCGGCCAAGCAGAT
CCGTGGTGATAAAGCCAAGCTCAACTTCCCAGATCTGCACCATCCTCCTC
CTCCTAATTATACTCCTCCGCCGTCATCGCCACGATCAACCGATCAGCCT
CCGGCAAGAAGGTCTGCGTTGTCTCTCAGAGTGAGAGCGAGTTAAGTCA
GCCGAGTTTCCCGGTGGAGTGTATAGGATTTGGAAATGGGGACGAGTTTC
AGAACCTGAGTTACGGATTTGAGCCGGATTATGATCTGAAACAGCAGATA
TCGAGCTTGGAATCGTTCCTTGAGCTGGACGGTAACACGGCGGAGCAACC
GAGTCAGCTTGATGAGTCCGTTTCCGAGGTGGATATGTGGATGCTTGATG
ATGTCATTGCGCG
> SEQ ID NO:104  45806_300075_1  Arabidopsis thaliana
AAATCAGTGAGAAGGTGCAAGTCGCTCACAAGAGAAGAAATCGACACTTT
```

Figure 1bb

```
TTGGAAAACGAAGAAGAAGAATGAAGAAGAAGAACATGTTCAAGCCTTTT
CCAAGTTGGTAACTCAGGAAGGTGCACAAAGCCAAGCGAAAGAGAAGAAG
AGTGTAGATGATCTTTTTGAGAACCAAAGCAAGAGTAGTGGATGGTGGAG
AAAAACCTACTGGGCGTTCTTGAATGAGCCGAGGGAGGAAGAGGGTCGAC
CGAACAACTACGTGTCGCAATTCAAAGTTGCTCACATCGCCAAAATTGCG
GGCTCGTAATGACGCTATAATCACCGGCTAATCACATATATATCTCGTGT
GAAATGCGATTAGTCGTCTGCCGTTGTGGTTTAATCACCGGCTAATCACA
TATATAGTATGTTGGCCGTGTTAGTATGTGAATGTGTGAGTAGAGCATGT
AACAAAGGGTGTACGATTTTAATGTAAGAATGTGTTTTACTTTATATGTG
TCATGTATGTATTTTTTGGTTGTGTGAGGGTGTAATGCGGCCGCAAAAA
TATCATTCATAGGGCCACTCTCATTTTTTTAGGATTTAGAACAAAATCC
GAAAAGGAGTGACATAACATTACAACATTAGGAATAAAGTAGATAAAACA
TTGATCAAAGGAAATTTAGTTATAGTTGAAAATTTTTATTATAAAAAGGG
AACGAAGGGAGATTTTTTCAAGGGCATTTTGGTCCACCCTCTTGAGTTTT
CCAGTTGTTGTAGCAGGAGCAAACTTGTTTGTTCCCATAGTAACCCGGAG
GCACACAGAGACACTTCCTGCAGCATTTGTTGCAGAACGTAATGCAAGCC
TTGTGGTACTGTGTCTTTTTACACCTCCTATCACATTCCGATGGGCATTG
GGTACGTTTCAGGCTTCCTGGTCCATAACGTTTCTGGCTCCACTTCACAT
TAGATCCACTTGAGGCCATAACCATGGTTTGAAGCATGAAGAGGACAATG
AGGGTCAAGAGGAAGATAGCTCCATATGACTTAGCCATTTTCAGTTTGGG
ATATTGTTATCCAAAGAACCAAACACTCCTCTAAATCTCCCGCG
> SEQ ID NO:105   45808_300075_1   Arabidopsis thaliana
GCAACATACGTCTTTTCTAAATCATTACATTTGAAGAAGAGAAACAAAAA
CAGAGCGGAATGCCGAATTTGTTTCTCTTCTCGATTCAACCATCCGAAAA
CAAGAATACAAAAGAGAAGATAATCGCGGAAACAGATTACGTAATAGAA
GCTTGAGTTGTTTTGTTTCTATTTCTTTTCGAGAAAGCTCCGAACTTCAG
CATCTGAGGGAAGAGCTGGAATGGCTCCTTTTTTGGTCGTTGTGATTGCT
CCACAAGCATTTGCGAATCTCAGCACTTTCCTCAATCTCTCTTCGTCCTC
GAGAACGGATCGATCATCGACAATCTGGTTTAGAAGAGCACCGACAAAGG
AATCTCCAGCTCCGGTTGTGTCCACAGCGTTCACATGGAAAGGGTCAACG
GCTCCTTTGAAAGTCTTGGTGTAATACCGACAGCCCTTTTCACCAAGAGT
GACTAACAACAGCTTCAAGTTGGGATGCCACAAGGTCAACGCGGTCTCAT
CATCAATCTTGTTGCTTCCAGTTAGAAACTCAAGCTCAACATCGCTCACC
TTGATGATCTCAGCTTTGTCCCAAATGCTCATGATCTGTGTTTTGGCTTC
TTCTTTTGATGGCCACAGAGGCTCCCTGAGGTTTGGGTCATAGGAAAGAA
GAGCTCCTGCGCG
> SEQ ID NO:106   45820_300075_1   Arabidopsis thaliana
AATTAGTCTTAATTGATACAAAAACATCATTAAAAAAGCAAGTGCAAAAA
TTCTGAGTAGAGAATGATAATAAAATGGAAAAAACTCAATAACCACCCTT
GAGATCGTTGACAACATCGTAAGGAATGGGAGTGACAGTCTCCAATGTCA
TACCTTCGACCATGAAACCCGGTTTAGGACCTTTAGGCTGTCTCTTGGTG
CTGATAGTCTCTCCTCTGGCTTTAGCATCAGCCTTAAGCACATCGTTCTG
CTTCTTTCTGAGTTTAAACTCCTCAGCACACCTTGACTGTTGCACATGCT
CCACACGCACATGTATCCTCTTCCTTATGATTCTGTTCCCAATCTGTTTG
TTGACTTCAACACCAACGGCACGCTTAGTGACATTCCAGATGCGACCAGT
ACGACCATGGTAGAACTTATGAGGCATACCCTTGTGGATAGCTCCATTAA
CCTTGACATCGACGTAATCGCCGACCTTGAAGGTTCTGAGGTAAGTGGAG
AGTGGAATATAACCCTTCTTCCTGAATGGTCTCGCGAACAGATCTCTTAT
TCTCGCCCTCACTCCGTGTCCCGCCGGCATTTTCAGCG
> SEQ ID NO:107   45837_300075_1   Arabidopsis thaliana
AAGCGAAGAGTCTGAAAGCGACTAAATGTACATTATAAAGAAACAGATTT
TGATTTTGAAAGATCTAGTAACAAAAACAAATTTCCGTTATCCCCATGTT
CTTATGCAGCCATGGGCACAGCTTCTGATGGTGCTGCAGCAGCTGCGTCT
GGGACGTACCAACCATGGTGAATTTCAACGGCTTTTTTCCTCCTAGCCAA
TCGAGACTTCCTACGGGCACCAGTGTTCTTGTGTAGTGCTTTAACCTTCA
CTGCTTTGTCAATTGCAGAATAAGCCTCTCCTATCAGTTTCTCCACCGTC
ACAATCTCATCAGCTTGCGCATCAGTTTTCTTCTTGAGCCCCTCAAGTGC
TTCCAAGACCTTCTTCATCCGGGTACGGGCTTCAGATTTCTTAGATTTGT
```

Figure 1cc

```
TGTAAACACGCCTCTTCTCAGCTTGGCGAGCTCTCTTTGCAGCTGAATCA
GCTTTCTTGGTAGGAGCAGCAGCCTCACACACAATCAATTGCCTCATTGG
CTTCTGTACCCACAAATTCCCGGTTGAGAAGGCGACGCATTGAGAAACGC
> SEQ ID NO:108  45848_300075_1  Arabidopsis thaliana
GTCTTCTTATGATTACCCTCTCTTCCCTAATTACATGGCTAATACTCAGT
CTTCTAAAGCCAAGGCTCGGTCTCAAAGTGCGCCGAAGCAGAGACCTCCT
GAGATCTATGAGAAGCAGATGAGTGGGAGGAGAAGATCTTCGATGGAAGC
ACCGAGGAATAACGGTGTCCCGAGAGCTGTAAGGATGCAGAGATCTTCAT
CTCAACTAGGGTCAAACACAGCCAAGGAAAGTCAACAACATCATCATCAT
CAGTACTATCCGTGGATGGCGATAAAGCTCGATAGATCTAATATTTCGCT
TATGGAGAGCGAATGCGGATCTACAAGTACCGTTATGACTAATACCAACT
ACGGTAGACATGTTGATGTTCAGGGAAACAACAACATGTACTGAACACTG
TGCTTTAGAATTTGAGAGATTGCTGGAAAAATAGGCAAGCCTAAAAAACG
AAGAGGACAGGTTTATAGGAGTTTTTTTTATGATGATGGAGATTTAACAA
TCTCTATATGTAAAGCAAAAAATGTAGTAGACTGTAGAAGTGACTCATCT
CGTCTTAAATTTTGATTTTTCCTTTTTAATTATCATTCGAATTAACGTTA
AGCGGCCGCGCTATCACACACCTTGGAAGAAAACGAAGTATTCCCTGCGC
AGTTTGGACGGGAGGTTCTAGCAGGGTTGCTAAAGATCCCAGATAGGGCC
GATTGGAGAAACTGTAAAATTAGCCAAGAAGAGGAGGCAAAGCTGGCTGA
AGATTTCAAGAAACAATTTCAAGAATTTGACCCTTGCCAATAACCTTACT
GAACAAAAGATACGATTAGATGCTATCTTGTGGGCATCAATCATGCTAAA
CTCAGTCTCCAGTGCACTCAGGTCAGAAGCTGAATCATGCGAAGCATCGT
CGTTTAGAAATAGGTTTGTCAACAGTGTTCTTTGTTTGGTCAGTTAAAAG
CTAACAGTCTTCCATCAGTTTCCTTACTATTTTACTGGTTAGTTGTTACC
TATCTTGTTCTTCTATTAAACATTTTTTTTGATATATTATTGTTTGTTGA
GATGTAAGAGAGTGATCATCACAGAAACACACAACAGTCATGGTAGAATT
TGCTTCACGCG
> SEQ ID NO:109  45850_300075_1  Arabidopsis thaliana
TGCATGTTCCCTAAGTTAACAGAGGAGACAAAAGATGATGATAAGTTACA
TTTTAGAACACAACCATATTTCCTCTTCAGACTCGCCACACAAACCTCTA
TAAGCGAGAGAAAGAAGCTGAAAAAACCACTCTCTTTCTTTATTTAGTA
AGAGTTTTGCCAGAGCTGCTGCTGAGATTGATTCGACGGTTGACCAGCCT
GAGACCCAGCACCATCCCTAGGGTTTTGCTGCTGGCGCTCGAGTGACATT
TCGGTCTGAGACTGATAATAATTTGGGTATCCATGAGATCCATAATGCTG
TTGTTGCTGAGCTTGGCGATACCCTCCCGCTGCTTGCTGAGCCTGCTGTT
GTTGTTGCTGGTGTTGTAGTTGCAGTTGTTGTTGTGCTTGGAGGTTGTAA
TACGTGTTAGTCGGGACACCTGACATGGTTCTGGAACCATGACCCTGATG
CCACATCGCCGAGTTTTCGTTCTGTTGTTGATGTTGCTGTTGTTGCTGCT
GCTGCTGAAGTGCCAACAGATGATTCTCTTTGTATTGAGAACTAAGAACA
TCGTCATAACCAAGCGTTGTACCGGTAGTAGCAGACTGTTGGTTAAGAGG
GAAGTTTCCGCG
> SEQ ID NO:110  45853_300075  Arabidopsis thaliana
ACTGAGTTCGATAGGATACTATTGTTCGAACAAATTCGTCAAGACGCCGA
AAATACCTACAAGTCAAATCCTTTAGATGCCGATAATCTGACTAGATGGG
GAGGAGTTTTACTCGAGTTATCTCAGTTTCATAGCATCTCAGATGCAAAG
CAAATGATTCAAGAGGCCATCACAAAGTTTGAAGAGGCATTGTTGATTGA
CCCAAAGAAAGATGAAGCGGTTTGGTGTATTGGGAATGCATACACTTCAT
TTGCGTTTCTGACTCCTGACGAGACTGAAGCTAAACATAACTTTGACTTA
GCTACTCAGTTCTTTCAACAAGCTGTGGATGAGCAACCAGATAATACACA
CTACCTGAAATCACTCGAAATGACGGCCAAGGCTCCACAGCTGCACGCAG
AAGCTTACAAACAAGGCTTAGGCTCACAACCAATGGGTCGCGTTGAAGCT
CCAGCACCGCCGAGCTCAAAGGCAGTGAAGAATAAGAAAAGTAGTGATGC
CAAGTATGATGCTATGGGTTGGGTGATTCTAGCCATTGGTGTTGTTGCTT
GGATCAGTTCGCGAAAGCTAATGTGCCTGTCTCTCCTCCTCGTTAAGTA
GACTCGTTAGGAGACTTTGATGAAGTTTTTCAATTTTTGAGGTTTTGACA
GTTGGAGCTTGTTGTGTAAGATTTTAGTTGTACTACGAGTACTTTATTA
GCG
```

Figure 1dd

> SEQ ID NO:111  45855_300075_1  *Arabidopsis thaliana*
GGGACGTCAAGGAGAGAGAGTTAGATTGTATGTTCGTGGAACAGTCCTCG
GTTACAAGAGGTCCAAGTCGAACCAATACCCTAACACTTCTCTCGTCCAG
ATTGAAGGTGTGAACACTCAAGAGGAGGTTAATTGGTACAAGGGTAAGCG
TTTGGCTTACATCTACAAGGCAAAGACAAAGAAGAACGGTTCTCACTACC
GTTGCATTTGGGGCAAAGTCACTAGGCCTCATGGTAACAGTGGTGTTGTC
CGTTCTAAGTTCACTTCAAACCTACCACCCAAGTCAATGGGAGCTAGAGT
CAGAGTCTTCATGTACCCTAGCAACATATGAGGAGGCTAGATTTCAACAA
GTATCGGAAGGAATCGCCATTATCATTTCTCAGGAGCTGTAGTTTTATCT
ATTCACTTTTATTCTAGACTCTCTGTTGGTTTTGATTTTATCTTGAGACG
AAGTAAAACATTTTTTTTCTTGAGATCATATACTATCGAGTATTAATGGA
ACTTGAGAAAAGCG
> SEQ ID NO:112  45864_300075_1  *Arabidopsis thaliana*
TTCTTACAGCATTCTATCCTGAAGATCACTGAATATACTAGAGGCAAATG
TTCCCAGCTTATTCTTTGTTTCCTCAGCTAAGTTAGCAATAGATGACATA
TCTTGCTGCGCCTGGAAAGAAATTCGGTTGATGAGATCGCTTGCAGTGAT
ATCGATGTTGGAATCATCTGGTCCGTGGCCAAAAAGATCAGAACTTGAAA
TAGCTGCTGAACCCGAGAACTTCTGAAGGGTAGCTTTTGAGTCAAGATCG
GCATCTCTGTTCTGATTTCCGAAAAATTGGGCAGAGGAAATCGATTTGGC
GTTTGAAAACTTCTTTCTTGCTTCATCTGTTTCTTCAACCTGAGCTTTGG
ATGAGCTTGAGCTTGACTTCTTGGGGAAAGCACTGTCCATTCCAAATTCA
TTAAAGAAATTTGATGACTTTGGTGGAGCAACATGGCTAAGCACCCGTGT
GCCACTTTGCCCACCAGATTGCTCATCATCAAAGTACTCAAATCGAGAGG
CAAATGATGATCCAGCTGCTGATGTGTCATTGGTTGGAGAAGCAGCAGGA
ATCACAGGTACAGGTTCTTCAGGCTTCTGCTCATAGAGGTTATCCTTTGA
CTTAGTAGTAAGCTTACGAGCACCAAGACCACCAGTCTTCCCAGACTTTC
GCGAAACAAGAGGTTTCTTAAACGTACTAGCAACAACTTTCTGAGAAGCT
TTTGGTGAAGAGACAACAGCTGCTTCTTGCTTCAAAGAACTCTCTTTCGG
AGATTCAGAAGTAAACCCATTTTCAGATGATTCCACTGGCTGAGAAGCGC
> SEQ ID NO:113  45866_300075_1  *Arabidopsis thaliana*
GCAACCTTCGATTTTCGTTTATTCGCATCCATCGGAGAGAGAAAACAATC
AATAAGCGACCATGTTGGTGTACCAAGATCTTCTCACCGGTGATGAGCTT
CTGTCTGACTCTTTCCCTTACAAGGAGATTGAGAATGGAATCCTCTGGGA
AGTAGAAGGAAAGTGGGTTACTGTGGGAGCTGTAGATGTTAACATTGGTG
CCAATCCATCTGCTGAAGAAGGTGGTGAGGATGAAGGTGTTGATGACTCT
ACTCAAAAGGTTGTTGACATTGTCGACACCTTCAGACTTCAGGAGCAACC
AACTTATGACAAGAAGGGATTCATCGCTTACATTAAGAAATACATTAAGC
TTTTGACACCCAAGCTCAGCGAAGAAGATCAAGCTGTCTTCAAGAAGGGT
ATTGAGGGAGCTACCAAGTTTTTGCTCCCCAGGCTCAGTGACTTCCAATT
CTTTGTTGGGGAGGGTATGCATGATGACAGCACTTTGGTCTTTGCTTACT
ACAAGGAGGGTTCAACTAACCCAACATTTTTGTACTTCGCTCATGGTTTG
AAGGAGGTCAAGTGCTGAGAGAGAAGCTCTCGTTGGGTTACTGTGGTCGG
TCGCAGCGACTCTCTAAGTTTATGTTTCTTTATATTGTCCTGTGTTTCGT
CGTCGTCCCCTATTAAAATTACCTGCCAGTTTACTTTTCTCTCTTCTTGT
TTTCTGTGTTGGAAGATTCTCAAGTTATTTATTCCGCAAAAAGCG
> SEQ ID NO:114  45869_300075_1  *Arabidopsis thaliana*
TACAAAGTTTACACTGTTGATGCATACGGATCTTTCCTTATCGATAACTT
CTCTACATTTATCAAGCAAGTGTATGCGGTTGGAGCAAGGAAGATCGGTG
TGACATCTCTGCCTCCAACAGGATGTCTTCCCGCTGCAAGAACCCTTTTC
GGTTTCCATGAAAAAGGCTGTGTTTCAAGACTCAACACAGATGCTCAAAA
CTTTAACAAGAAGCTTAACGCTGCTGCTTCAAAGCTTCAGAAGCAATATT
CCGATCTTAAGATTGTTGTCTTCGACATCTACTCTCCACTTTATGATCTT
GTTCAGAACCCTTCCAAATCCGGATTCACGGAAGCAACCAAAGGATGTTG
TGGAACAGGAACAGTCGAGACAACTTCACTCTTGTGCAACCCGAAATCGT
TTGGGACATGCTCCAATGCTACTCAGTATGTGTTCTGGGACAGTGTGCAT
CCTTCTGAAGCTGCCAATGAGATTCTTGCCACTGCCCTAATTGGACAGGG
CTTTTCTCTCCTCGGTTGATCTCACGTATTTTCTTATATTCTCTTTTCA
AATCGCTGTTTCTATCACACATTGAGTCATACATTTGTTTTTCGCG

Figure 1ee

> SEQ ID NO:115 45874_300075_1  *Arabidopsis thaliana*
GACAAATTCTTCCATTAGAAGAAGAAGATGGCTCTTCTCTGCTTCAATTC
TCTCCCTTCTCTCTCTTCTCTTTCTTCTTCTTCCTCGCGCCTTCTTC
AATCTCCGTCTTTCGCTTCTCCAGTTTTGAGCCTTAAACCCAACGCTGTC
GAGTCCAAGAACAGAGTCTCTCTCAGTGCTTACAGCTTGAACTCTAGCCA
TGGAAGAATTGTGGTGAAGGCGGCTGCTTCTGGCGTGGACGGGGCTGAGC
CTGAGAGCAAGGAGGAACCAAAGACTGTTGTTGCTGCTGTTCCAGTGGAT
AAACTACCGTTGGAATCGAAAGAAGCTAAAGAGAAACTGCTCTTGGAATT
GAGGCTGAAGATGAAGCTGGCCAAAAAGATTAGGCTACGCAGGAAACGTC
TGGTTCGTAAGCGTAAGATGAGGAAGAAGGGTCGATGGCCACCTTCCAAG
ATGAAGAAAAACAAGAATGTCTAAGTGACTCAACTGTTTGCTGCTTTTCG
TATTCGTTTTTTGTAATGTTCTTTTTGGTGTTCAAAGACCATTAATGTAC
TTCAAATGCAACCATTGTTTTT
> SEQ ID NO:116 45889_300075_1  *Arabidopsis thaliana*
GCGTCGACCTAGTGAGCTACTTCAGATTCCGGCCATCACGCAGCTCCAGT
TGTATGCTTTGAGAGTTAATACAAAGATGACAACAATCGAAACCGGTCAG
AAAACTCAAAAGTCTTCTCCTTCCGGTTCTGGTACTACCCCTACTGGTAC
TCTTAAGCAGTCATCAGCATCGTTTAAAAGGTGGGGAAGGAGACACCCGT
TTGTAAGATATGGACTTCCGATGATATCTCTCACTGTATTTGGAGCCCTC
GGACTCGGCCAACTCCTTCAAGGCAGTTCAGTAAGGATATTGCAAAGGTA
AAAGATGACCAAGAATGGGAGATTATAGAAACAAGAAAGGCACTTTCGAG
AACAGGACCTGTCGATGCCTATAAACCTAAAAACACATCCATTGAAGATG
AGCTCAAGGCTATGCAAGAGAAGGTGGACATAAACACGTACGAGTACAAG
AAAATTCCAAAGCTAAACGAAAGCAAGTCGAGTTAAGAAGAGTCTTTGTA
TAAGATTAGTCTTTTTAGATGTGTTTCAGTTTTAAATGACTCTTCAGTTC
ACATAATCGCCCAAGTACAAATTCCAGTAAGTTCTGTCTGGGCTTCCTAA
AACCAAGAACAACGAGGGACTT
> SEQ ID NO:117 45891_300075_1  *Arabidopsis thaliana*
GTCGATGTGTACGTCCGTGTAACCGGAGGAGAAGTGGGAGCCGCCAGTTC
TCTAGCTCCAAAGATCGGTCCTCTCGGTCTCGCACCAAAGAAGATCGGAG
AAGACATCGCGAAAGAGACGGCCAAAGAATGGAAAGGACTTCGTGTCACC
GTGAAGCTGACGGTTCAGAATCGTCAAGCTAAGGTAACCGTGGTTCCATC
TGCTGCAGCTCTCGTCATCAAGGCGTTGAAGGAGCCAGAGAGAGACCGTA
AGAAGGTGAAGAACATTAAGCATAACGGTAACATCTCTTTCGATGATGTG
ACTGAGATTGCTAGGATTATGAGGCCTAGATCTATTGCTAAGGAGCTGAG
TGGGACTGTGAGGGAGATTCTTGGAACGTGTGTCTCTGTGGGATGCACTG
TTGATGGGAAAGACCCTAAGGATCTTCAGCAGGAGATTCAAGAAGGTGAG
ATTGAGATTCCTGAGAATTAAGGAACAATGGAGTTTTTTTTCTTCTTAT
GGGAATTTGAAATGCTTCTGTTGTTATCTTTCTCGTTTTACCATATTTTG
TTTTTGTTTGGGAACTTAGCTGCTATGATGTTTCACTTAGAATGACTCTC
AAGTTTTGGATTCTTATTATTCTCTGTTTC
> SEQ ID NO:118 47330_300170_1  *Arabidopsis thaliana*, antisense
GTTTCCTTGGTGGAAGTGCTGACCTTGCATCATCCAACATGACATTGCTG
AAAGCCTTGGCGACTTCCAAAAGGCCACACCTGAAGAAAGAAATCTTAGG
TTTGGTGTTAGGGAGCACGGAATGGGAGCCATCTGCAATGGCATTGCCCT
TCACAGCCCCGGTCTTATCCCTTACTGTGCGACGTTCTTTGTCTTCACCG
ACTACATGAGAGGTGCCATGAGAATCTCAGCTTTGTCTGAAGCTGGTGTT
ATCTATGTTATGACCCATGATTCCATTGGTCTTGGAGAAGATGGACCAAC
CCATCAGCCCATTGAGCACATTGCAAGTTTCCGTGCTATGCCCAACACTC
TTATGTTCCGTCCTGCTGATGGAAATGAA
> SEQ ID NO:119 56465_300139_1  *Arabidopsis thaliana*, antisense
TGCAGCAATCTCTAGCTCAGAACCAGTTCCAATCAAGATCACATCGGGTT
TGTTGCCTGAAGAGTCGTCAGAAATTGTATATCACCCTTTTCCACTCCTT
CGATGGATGTACCTGGAAGATGAGGCAGCTTTTGCCTAGACAGAGCTAAG
ATAGATGGTGTCTTGCGCTTGGTGACAGCGATCTTGTATGCACCGGCTGC
GGAGGTGCTCAGGAAAGACGGCAAAACCGTTAGAGTTGTTTCTTTCGTGT
GCTGGGAACTATTTGACGAGCAATCAGATGAATACAAGGAGAGTGTGTTG
CCATCGGATGTATCAGCTAGAGTTAGCATTGAAGCAGCTTCGACTTTCGG

Figure 1ff

ATGGGGAAAGATTGTTGGAGGCAAAGGAAAGTCCATTGGTATTAATTCAT
TCGGAGCCAGCGCACCAGCACCCTTACTCTACAAGGAGTTTGGTATCACC
GTTGAAGCTGTTGTTGATGCGGCCAAGTCATTCTTCTAAGAGATTTAAGA
TCGGACCATTCTCTCTGAGGGGGTTTTGTCTGAAACTTGATTTGGAAACA
AGGCTATTCACAACATTGTCTCATATCTCGAAATAAAGTGCAACAAGACA
CAAAGACTTTCACTTTCTTTTTTGTTTTTGTTTTTGTACTTCAGGTCAA
GATAGGTTTTCGGTTTGAAGAGAAACAAATTAGAAAGACAATGTAAAA
CTCCCATGATCATTCGTGTAATGCTAAATGCTTGAATTTCAGCAAAAAA
AAAAAAAAAAAAAAAAAAAAAAAAAAAAAAAAAAAAAAAAAAAAAAAA
AAAAAAAAAAAAAAA

> SEQ ID NO:120  104781_300367_1  Nicotiana benthiminana, antisense

GGAAAACAATCACCTGGTTGTTTGTTTCGGGGAGTTGTTGATTGACTTCG
TTCCTACTGTATCTGGAGTTTCACTTGCAGAAGCGCCTGGATTTGAGAAA
GCTCCTGGTGGAGCTCCAGCTAACGTTGCAGTTGGTATAGCAAGATTAGG
AGGTTCTTCCGCCTTTATTGGCAAGGTGGGTGCAGATGAATTTGGTTATA
TGTTATCTGATATATTAAAACAGAACCATGTCGACAATTCTGGCATGCGT
TTCGATACCCATGCAAGGACAGCATTAGCATTTGTCACTTTGAGAGCAGA
TGGCGAGAGAGAATTCATGTTTTTCCGCAATCCAAGTGCTGATATGCTTC
TTACAAAGGAAGAGCTGGACAAAGATCTCATTCAGAAGGCAAGAATATTT
CACTATGGGTCAATCTCTTTAATCGCGGAACCGTGTAGGTCAGCTCATCT
TGCAGCCATGGAGATTGCCAAAAAAGCTGGCTGCATTCTCTCTTATGACC
CAAATCTAAGGTTGCCCTTATGGCCATCCGCAGATGCTGCTCGTAAAGGC
ATCTTGAGCATTTGGGACCAAGCCGACGTTATTAAGGTAAGCGAAGACGA
AATCACATTCTTGACAGACGGTGAAGACGCCTACGATGACAATGTGGTGA
TGACTAAGCTTTTCCACCCAAACCTTAAGCTTTTGCTGGTTACCGAAGGG
GGAGAAGGTTGCAGATACTATACTAAGAATTTTCACGGGAGAGTGAATGG
CATTAAAGTAACAGCAGTTGATACCACAGGAGCAGGTGATGCATTTGTTG
GCGGACTTCTCAACAGTATGGCCACAGATCCAGACATTTATCAGGATGAG
AAGAAACTAAGGAATGCACTCCTTTTTGCCAATGGTTGTGGAGCTATAAC
TGTGACAGAAAAAGGAGCAATTCCTGCATTGCCAACAAAAGCAGCAGTGC
TTAAAATCTTGGATGGTGCCACAGCTAACTGATCCAATCAAATTCCCCCC
ACCCACAGAAAAGCCTCCTAATCTCCACCCCTTGTAAGACACTACACTAG
TACTTCGTGTACAAATTATCATATATACTGGAATTTACTCCAAAAAAAAA
AAAAAA

> SEQ ID NO:121  105039_300046_1  Nicotiana benthiminana, antisense

GCTTCTTCTTCTTCTCTCACTCTCTCTCAAGCTATCCTCTGTCGTTCAGT
CCCTCGCCATGGCTCTGCCTCTTCTTCTCAACTTTCCCCTTCTTCTCTCA
CTTTTTCCGGCCTTAAATCTAACCCCAATATCACCACCTCCCGCCGCCGT
ACTCCTCCCTCCGCCGCCGCCGTACGGTCATCGACGATTCGTGCATCGGC
TGCAACCGAAACTATACAGAAAACTGAGACTGCCCTTGTTGACAAATCTG
TAAACACTATTCGATTTTTGGCTATTGATGCTGTTGAAAAGGCAAATTCG
GGTCACCCCGGTTTGCCCATGGGTTGTGCTCCGATGGGTCATATACTGTA
CGATGAGGTTATGAGGTATAACCCGAAAAATCCGTATTGGTTTAATCGGG
ATCGGTTTGTTCTATCAGCTGGACATGGTTGTATGCTTCAGTATGCTTTG
CTTCATCTAGCTGGCTATGATGCTGTCAAGGAAGAGGACTTGAAGAGCTT
CCGTCAGTGGGGAAGCAAAACCCCTGGACACCCTGAAAACTTTGAGACAC
CTGGTGTTGAAGTCACCACCGGGCCTCTGGGACAAGGTATTGCCAACGCC
GTTGGCTTGGCCCTTGC

> SEQ ID NO:122  107582_300379_1  Nicotiana benthiminana, antisense

TTTTCTTCTTTATTGTATAGATATATACTTTACATACACATATTCTCTCT
ATTCATAGTCGGTATGGCAGCTAACGGCGTTAGTTCTGGTTTAATTGTGA
GCTTCGGCGAGATGTTGATCGATTTCGTGCCGACGGTCTCCGGCGTTTCC
CTTGCCGAGGCTCCGGGTTTCTTGAAGGCTCCTGGCGGTGCACCGGCAAA
CGTCGCCATCGCAGTGACTAGGCTCGGGGGAAAGTCGGCGTTCGTTGGGA
AACTCGGCGACGATGAGTTCGGCCACCTGCTCGCCGAGATACTCAAAAAG
AACGGCGTTCAAGCCGACGGGATCAACTTCGACAAGGGAGCGAGAACGGC
ATTGGCATTCGTGACCCTACGCGCCGACGGAGAGCGTGAGTTCATGTTCT
ACAGGAATCCCAGTGCTGATATGTTGCTCACTCCCGACGAGTTGAATCTT

Figure 1gg

```
GATGTTATTAGATCTGCTAAGGTGTTCCACTACGGTTCGATAAGTTTGAT
AGTGGAGCCATGCAGATCAGCACATTTGAAGGCAATGGAAGTGGCAAAGG
AGGCAGGAGCATTGCTCTCTTATGACCCAAACCTCCGTTTGCCGCTGTGG
CCGTCGGCAGAGGAGGCGAGGAAGCAAATCAAGAGCATCTGGGACGAGGC
AGATGTGATCAAGGTGAGTGATGTGGAGCTGGAATTCCTAACCGGAAGTG
ACAAGATTGATGACGAATCTGCCATGTCCTTATGGCATCCTAATTTGAAG
CTCCTCTTGGTCACCCTCGGTGAGAAAGGCTGCAATTATTACACCAAGAA
TTTCCATGGAGGTGTTGAGGCATTCCATGTGAAGACTGTTGACACCACCG
GAGCTGGTGATTCTTTTGTTGGTGCCCTTCTAACCAAGATTGTTGATGAC
CAATCCATTCTTGAGGATGAAGCAAGACTGAAGGAAGTACTAAGGTTTGC
ATGTGCATGTGGAGCCATCACAACAACCAAGAAAGGAGCAATCCCAGCTC
TTCCTACTGAATCTGAAGCCCTCACTATGCTTTACGGAGGAGCATAGGAC
GAAGATGATGTTACCCTTTTAATTCTTTTTAATCGTGATATATTTCGACC
GTTTACGAGTTTTTCCTTTCAATCAATCAAAATAGTTTCAGCCTTTCATT
TCACTTTTGGGGTTTCGGATTTTAATGGTTTCTTGTAATGATGAAAGACT
ATGCATTAAGGCACTTAATAAAGTAAGCTTTCTTCCTAAAAAAAAAAAA
AA
> SEQ ID NO:123  109167_300043_1  Nicotiana benthiminana, antisense
ATACTTTACATTTATACATATATTCTCTCTATTCATCGTCGCTATGGCAG
CTAACGGCGTTAGTTCTGGTTTAATTGTGAGCTTCGGCGAGATGTTGATC
GATTTCGTGCCGACGGTCTCCGGTGTATCCCTTGCCGAGGCTCCGGGTTT
CTTGAAGGCTCCCGGAGGTGCACCGGCAAACGTCGCCATCGCAGTGACTA
GGCTTGGGGGAAAGTCGGCGTTCGTCGGGAAACTCGGCGACGATGAGTTT
GGCCACATGCTCGCCGGGATACTAAAACAAAACGGCGTCCAAGCGGACGG
GATCAACTTTGACAAGGGCGCGAGAACGGCGTTGGCATTCGTGACCCTAC
GCGCCGACGGAGAGCGTGAGTTCATGTTCTACAGGAATCCCAGTGCCGAT
ATGTTGCTCACTCCCGGCGAGTTGAATCTTGATGTTATTAGATCTGCTAA
GGTGTTCCACTACGGTTCGATAAGTTTGATAGTGGAGCCATGCAGATCAG
CACATTTGAAGGCGATGGAAGTGGCAAAGGAGGCAGGGGCGCTGCTCTCT
TATGACCCAAACCTCCGATTGCCGCTGTGGCCGTCGGCA
> SEQ ID NO:124  112163_300040_1  Nicotiana benthiminana, antisense
GGATGGCCTTATGAGCCGTTCCACGTGCCTGAAGATGTCGGGAGCCATTG
GAGTCGTCATGTTCCCGAGGGTGCTGCTCTTGAAGTTGGATGGAATACCA
AGTTTGCTGAATATGAGAAGAAGTACCCCGAGGAAGCTGCAGAACTCAAA
TCCATTACCACTGGTGAACTAACTGCTGGCTGGGAGAAAGCTCTGCCTAC
CTACACACCTGAAAGTCCAGCGGATGCCACCAGAAACTTGTCCCAACAAA
ACCTGAATGCTCTTGCCAAGGTTCTCCCTGGTTTCCTTGGTGGTAGTGCT
GATCTCGCCTCATCAAACATGACTCTCATGAAAATGTTTGGTGACTTCCA
AAAGAACACCCCAGAGGAGCGTAATCTAAGGTTTGGTGTTCGTGAACATG
GTATGGGAGCTATATGTAATGGGATTGCTCTACACAGCCCTGGCTTGATT
CCCTACTGTGCTACTTTCTTTGTGTTCACTGACTACATGAGAGGAGCAAT
GAGAATTTCAGCCTTGTCTGAGGCTGGAGTTATTTATGTTATGACCCACG
ATTCAATCGGT
> SEQ ID NO:125  115126_300012_1  Nicotiana benthiminana, antisense
AAAACCCCTGGACACCCTGAAAACTTTGAGACACCTGGTGGTGAAGTCAC
CACCGGGCCTCTGGGACAAGGTATTGCCAACGCCGTTGGCTTGGCCCTTG
CAGAGAAACACTTGGCTGCTCGCTTCAATAAGCCTGACGCTGAGATTGTA
GACCACTACACATATGTTATTCTCGGTGATGGTTGCCAGATGGAGGGTAT
TTCACAAGAAGCTTGTTCACTTGCTGGACACTGGGACTTGGAAAGCTGA
TTGCTTTCTATGATGACAACCACATCTCAATTGATGGTGACACAGAAATC
GCTTTCACTGAGGATGTTGGTGCCCGTTTTGAGGCTCTTGGGTGGCACGT
AATCTGGGTGAAGAACGGTAACACTGGTTATGATGAGATTCGTGCTGCTA
TTAAGGAAGCAAAAGCTGTCACAGACAAACCCACTATGATCAAGGTGACT
ACAACCATTGGTTTTGGCTCGCCCAACAAGGCAAACAGTTACAGTGTACA
TGGAAGTGCACTTGGAGCTAAGGAAGTAGAGGCCACCAGGAGTAACTTGG
GATGGCCTTATGAGCCGTTCCACGTGCCTGAAGATGTCAAGAGCCATTGG
AGTCGTCATG
```

Figure 1hh

> SEQ ID NO:126 118113_300064_1 *Nicotiana benthiminana*, antisense
TTGTTGCTGAGCATGCCGCTGCCAATAACAAGATATTCTCGATGAACCTT
TCTGCACCATTCATCTGCGAGTTCTTCAGGGATCCACAAGAGAAAGCCTT
GCCGTATATGGATTTTGTATTCGGAAATGAGACCGAAGCAAGAACCTTCT
CAAAAGTACATGGATGGGAGACTGATAATGTTGAAGAAATAGCTCTGAAA
ATATCTGAATGGCCAAAGGCATCTGAAACACACAAAAGGATCACTGTTAT
TACACAAGGTGCTGATCCTGTTGTTGTTGCTGAGAATGGGAAGGTGAAGT
TGTTCCCTGTAATACCGTTGCCAAAAGAGAAACTTGTTGACACCAATGGT
GCTGGGGATGCATTTGTTGGGGATTCTTGTCACAATTGGTTCAAGGAAA
ACCTGTTGAAGATTGTGTAAGAGCAGGATGTTATGCGTCAAATGTTATCA
TCCAAAGGTCGGGTTGCACATACCCTGAGAAACCAGATTTTGCATAAGAT
AAGTTCTTATTCTTGGTTTCTAGTTTTATGTTGACAGAACATATTCGACT
TCTAGTATTTAGTACTCGGTCGAGTAATTCCAATTTTTGGGCTATTGTTC
CCAAAATTCTACCCATGTTGTAAGGAATTTTGATTGCCCTTACATTATTT
GAGATTTGAGAATAACATTGTACTAGAAAATTTAGAAAATTTCTTCCAAT
TTCTGGGCTATTGTTCCCATTTGTAAGGAATTTTGACTGTTTTTTCATAT
CATTCGAGAATAACATTGTATTAGGAAATAAAAAAAAAAAAAAAAAAAAA
AAA
> SEQ ID NO:127 120136_300359_1 *Nicotiana benthiminana*, sense
CCCGTTGTTTCCTTTGTTTGTTGGGAGCTTTTCGAAGAACAATCAGCCGA
CTACAAGGAAAGTGTCCTTCCATCATCTGTTACAGCTAGAGTTAGCATTG
AAGCTGGATCCACATTTGGGTGGGAGAAATATGTCGGATCAAAGGGGAAG
GCCATCGGAATTGATAGATGGGGTGCCAGTGCCCCTGCTGGAAAAATATA
CCAGGAGTACGGAATTACAGCAGAGGCTGTTGTAGCTGCAGCTAAACAAG
TTTCTTAGGCTTTATTACTTACACTTGGTTGCTGGTGTCTACCAAATTTG
TTTTCAGTTTGACACTGAGGTTGGAGGTGATGGTGGAAACCAATACCAAA
CGGACTCGGCAGTTCACTGTTGCCTGGTATTTTCAATAAAAACTATTTCT
TCATCTGCCCTTTGTTTTCTTCAGTTTTAGTAGCGGAGCGGCCAAAATGA
ATCCAAGATGAGGATAGAAATAGGATTATGGATGCTCCTGACCATGTACA
CTTTAAACCATATCTTTGAGTTTTGTAATTTCATTTGGTCGAGTGATACC
AAGATCTTATTTTCA
> SEQ ID NO:128 121540_300358_1 *Oryza japonica*, sense
CCCCCCAAAATACATCTACATTGCTGGCTTTTTCCTTACGGTCTCCCCAG
ATTCTATTCAGCTTGTTGCTGAGCATGCTGCCGCTAACAACAAGGTGTTC
CTGATGAACCTCTCTGCACCCTTTATCTGTGAGTTTTTCCGTGATGCCCA
GGAGAAGGTTCTTCCGTTTGTGGACTACATCTTCGGTAACGAAACAGAAG
CAAGAATCTTTGCTAAAGTCCGTGGATGGGAGACTGAGAATGTTGAGGAG
ATCGCGTTGAAGATTTCCCAGCTTCCATTGGCCTCTGGAAAACAAAAGAG
GATTGCCGTGATTACTCAAGGTGCTGATCCAGTAGTTGTCGCTGAGGATG
GACAGGTGAAAACATTCCCTGTGATCCTACTGCCAAAGGAGAAGCTTGTT
GACACCAATGGCGCTGGTGATGCCTTTGTTGGAGGCTTCCTCTCACAATT
GGTTCAACAAAGAGCATTGAGGACTCTGTGAAGGCTGGTTGCTATGCCG
CAAATGTTATCATCCAGCGTTCTGGCTGCACTTACCCTGAGAAGCCTGAT
TTCAACTAGGGCTAACCCAACCACATATTGAGGAACAATTATTCGCACAT
CCAACCTACTAGTGGTTTGGTGTGTTCTACCTGTACCATCTCGAGGCTTT
CCATATGATCCGGCCAATATTTTTTTGCCGTGATTTTTGTTTCACTGCTG
CAAACCTTACTTTATTCTCGGTATAAGGCACAATTGCCAATCGGTGTGTT
GTTTTGGTC
> SEQ ID NO:129 127617_300471_1 *Nicotiana benthiminana*, sense
CATACATTTTATCAGACAATTCTTCTGGCAGGGAAACCTGATGTCATTTT
GATTGGTACTGGCTCAGAGTTAGAAATTGCTGTCAAGGCTGCTGATGAAC
TCAGGAAAGAAGGAAAGACAGTGAGAGTTGTTTCCTTTGTTTGTTGGGAG
CTTTTCGAAGAACAATCAGCCGACTACAAGGAAAGTGTCCTTCCATCATC
TGTTACAGCTAGAGTTAGCATTGAAGCTGGATCCACATTTGGGTGGGAGA
AATATGTCGGATCAAAGGGGAAGGCCATCGGAATTGATAGATGGGGTGCC
AGTGCCCCTGCTGGAAAAATATACCAGGAGTACGGAATTACAGCAGAGGC
TGTTGTAGCTGCAGCTAAACAAGTTTCTTAGGCTTTATTACTTACACTTG
GTTGCTGGTGTCTACCAAATTTGTTTTCAGTTTGACACTGAGGTTGGAGG

Figure 1ii

TGATGGTGGAAACCAATACCAAACGGACTCGGCAGTTCACTGTTGCCTGG
TATTTTCAATAAAAACTATTTCTTCATCTGCCCTTTGTTTTCTTCAGTTT
TAGTAGCGGAGCGGCCAAAATGAATCCAAGATGAGGATAGAAATAGGATT
ATGGATGCTCCTGACCATGTACACTTTAAACCATATCTTTGAGTTTT

> SEQ ID NO:130  137105_300502_1  *Oryza indica*, sense
CCCCCGATCGCTTCTCATCGCAAATCGCATGGACTTCGATTCGCTTCGTT
TCGTTCTCGCTGTTGATTTGTTCGTGAGATTTGAATTCTAGCAATGGCTC
CTCTCGGTGACGGAGCGGCGGCGGCGGCGGAGCCCAACCTGGTGGTG
TCGTTCGGGGAGATGCTGATCGACTTCGTCCCCGACGTCGCCGGCGTCTC
GCTGGCCGAGTCCGGCGGCTTCGTCAAGGCTCCCGGCGGCGCCCCCGCCA
ACGTCGCCTGCGCCATCTCCAAGCTCGGCGGCTCCTCCGCCTTCGTCGGC
AAGTTTGGTGATGATGAGTTCGGGCACATGCTGGTGGACATCCTGAAGAA
GAACGGGGTGAACGCGGAGGGGTGCCTGTTCGACGAGCACGCGCGCACGG
CGCTGGCGTTCGTGACCTTGAAAAGCAACGGCGAGCGCGAGTTCATGTTC
TACCGGAACCCGAGCGCCGACATGCTCCTGACGGAGGCGGAGCTCAACCT
GGACCTGATCCGGCGCGCCAAGATCTTCCACTACGGCTCCATCTCCCTCA
TCACCGAGCCGTGCCGCTCCGCCCACGTCGCCGCCATGCGCGCCGCCAAG
TCGGCCGGCAT > SEQ ID NO:131  142105_300432_1  *Oryza japonica*, sense
CCCCCGCTTCGTCCTGCTGATGGTAACGAGACTGCTGGGGCATACAAAAT
CGCGGTGCTCAACAGGAAGAGGCCATCCGTCCTTGCTCTCTCCAGGCAAA
AGCTTGCTCAGCTGCCTGGTACCTCGATTGAGGGTGTTGAGAAGGGTGGG
TACATCGTCTCTGACAACTCAACTGGCAACAAGCCTGACTTCATTGTGAT
GAGCACTGGCTCTGAACTAGAGATTGTCGCCAAGGCTGCTGATGAGTTGA
GGAAGGAGGGGAAGACTGTCCGTGTCGTGTCATTTGTTTGCTGGGAGCTT
TTCGATGAACAGTCGGCTGAGTACAAGGAGAGTGTTCTCCCTGAGGCTGT
TACTGCAAGAGTCAGCCTTGAAGCAGGGTCTACTCTTGGATGGCAGAAGT
ACGTCGGAAGCAAAGGCAAGGCTATTGGCATCGACAAATTCGGTGCAAGT
GCTCCTGCTGGAAAGATCTACCAGGAGTATGGCATCACCGCGGAGAACGT
CATCGCAACAGCAAAGAGCCTGTAAGATTCAAACCGCGCGTTTTGAGTTT
TTGTCATCGTTGATGCCAAGGAACAGTATACATGAAGCCATGAAGGTCTT
GTGCCCAAAGCTTGGAATAATGAAGGGAGAGGGATGCCTGCATTGG > SEQ ID NO:132  142388_300434_1  *Oryza japonica*, antisense
CCCCATGACATTGCTTAAGATGTTCGGTGACTTCCAAAGGGATACGCCTG
AGGAGCGCAATGTCCGATTTGGAGTCAGGGAGCATGGAATGGGCGCCATT
TGCAACGGCATTGCTCTGCACAGCCCAGGACTCATTCCATACTGGGCTAC
TTTCTTTGTTTTCACTGATTACATGAGAGCTGCCATGAGGATCTCAGCCT
TGTGTGAAGCCGGAGTTATCTATGTTATGACCCATGACTCTATTGGTCTT
GGAGAAGATGGTCCAACCCATCAGCCCATTGAGCACTTGGTGAGCTTCCG
TGCGATGCCCAACATTCTGATGCTTCGTCCTGCTGATGGTAACGAGACTG
CTGGGGCATACAAAATCGCGGTCCTCAACAGGAAGAGGCCATCCGTCCTT
GCTCTCTCCAGGCAAAAGCTTGCTCAGCTGCCTGGTACCTCGATTGAGGG
TGTTGAGAAGGGTGGGTACATCGTCTCTGACAACTCAACTGGCAACAAGC
CTGACTTCATT > SEQ ID NO:133  170474_300533_1  *Oryza indica*, sense
GATGGTACGCATCATCGGCCCAAGTCCAGCTCAATCCTCCTCACCAACAC
CAAGACGACCACGACCTCCTCGCCCTCGCCGCCGCCCACCGACCATGGCC
TCCGCCGCCGCTTCTTCCTCCAAACCTCCCGTCGTGCTTGGCTGCGGCGC
CGTCTCCGCGGACTACCTCGCCACCGTCGCCTCCTTCCCCAACCCCGACG
ACAAGATCCGAAGCCTAACGCTCAAGGTCCAGGGAGGCGGCAACACTGGC
AATGCCTTGACCGCCGCTGCTCGTTTGGGCCTTCGCCCAAGGATCATATC
CAAGGTATCCAATGACCCACAAGGAAGAAATATTCTCAAGGAGCTGCAAG
ATGATGGGGTCGACACCTCTCATATCCTGGTTGCAGAGGAGGGGAATTCA
CCTTTCACCTATATAATTGTTGACAACCAGACGAAAACTCGTACTTGTAT
TCACACTCCTGGTTATCCTCCTATGGTCCCTGAAGAGCTCACACAAGAAA
ACTTGTTTGCCGCTTTAGACGGTGCTGACATTGTATATTTTGATGTCAGA
TTGCATGAAACTGCTTTACTAGTTGCTGAAGAGGCAAGCCAAAGAAAACT
TCCTATTTTGATTGATGCCGAACGGAAGAGGGATGGATTGGACGAGCTTC

Figure 1jj

```
TCAATTTCGCATCTTATGTTGTATGCTCTGCAAAATTTCCTCAGGCTTGG
ACAGGAGCCTCATCAACACCGGTTGCTTTGGTGTCCATGCTTTTAAGATT
GCCTAATATCAAGTTTATTATTGTAACCCTTGGAGAAAAGGGATGCTTGA
TGCTTGAAAGAAGCACAACAGATGCTTCTGAGGCAGAGGAAATAGATGTA
GAGAGTCTTCTGGAATCACTAGAGAAGAAAGAAGTTTTGAGTTCAAGCAT
GCCAAAATGCATCGCCTCCAAGTCAAATTTGAGAATAAGTGCAGATGGAA
TAGGATCCATCAGTGGCAGATTACTTTTAGGCACTGCCGAAATTATACCC
TCTGAAGAGCTCATAGATACAACTGGTGCGGGTGATGCATTTATCGGAGC
AGTTCTCTACGGTTTATGCTCTGGCATGCCGCCTGAGAAGATGCTGCCTT
TTGCAGCTCAAGTGGCTGCTTGCGGGTGCAGGGGTTTAGGGGCTCGGACT
GCTCTTCCCCATCGCACAGATCCCCGCCTGGTTGCCTATTGACTCGAGGA
ACTGTAGTGTATCAATCTGTGTTGGATCTGATTGGGATGGATTCATTGGA
TTGTGGGCGCCTTTGAAAAATAAGAGATTAAGCATTTGAAATATGGAGTA
ATAAGAAAGCCGCCTGCAGTTGAAATCGGTTCCTAAGTTGTATGTAAACA
GTGATTGTTGTTGCATACTGTCAATATACCTTGGCTTGTGTTAATAAGAG
AGATTTGTGTGCTGTTGTTGCAAGGCCC
> SEQ ID NO:134  172017_300539_1  Oryza indica, sense
GATGGTACGCATCATCGGCCCAAGTCCAGCTCAATCCTCCTCACCAACAC
CAAGACGACCACGACCTCCTCGCCCTCGCCGCCGCCCACCGACCATGGCC
TCCGCCGCCGCTTCTTCCTCCAAACCTCCCGTCGTGCTTGGCTGCGGCGC
CGTCTCCGCGGACTACCTCGCCACCGTCGCCTCCTTCCCCAACCCCGACG
ACAAGATCCGAAGCCTAACGCTCAAGGTCCAGGGAGGCGGCAACACTGGC
AATGCCTTGACCGCCGCTGCTCGTTTGGGCCTTCGCCCAAGGATCATATC
CAAGGTATCCAATGACCCACAAGGAAGAAATATTCTCAAGGAGCTGCAAG
ATGATGGGGTCGACACCTCTCATATCCTGGTTGCAGAGGAGGGGAATTCA
CCTTTCACCTATATAATTGTTGACAACCAGACGAAAACTCGTACTTGTAT
TCACACTCCTGGTTATCCTCCTATGGTCCCTGAAGAGCTCACACAAGAAA
ACTTGTTTGCCGCTTTAGACGGTGCTGACATTGTATATTTTGATGTCAGA
TTGCATGAAACTGCTTTACTAGTTGCTGAAGAGGCAAGCCAAAGAAAACT
TCCTATTTTGATTGATGCCGAACGGAAGAGGGATGGATTGGACGAGCTTC
TCAATTTCGCATCTTATGTTGTATGCTCTGCAAAATTTCCTCAGGCTTGG
ACAGGAGCCTCATCAACACCGGTTGCTTTGGTGTCCATGCTTTTAAGATT
GCCTAATATCAAGTTTATTATTGTAACCCTTGGAGAAAAGGGATGCTTGA
TGCTTGAAAGAAGCACAACAGATGCTTCTGAGGCAGAGGAAATAGATGTA
GAGAGTCTTCTGGAATCACTAGAGAAGAAAGAAGTTTTGAGTTCAAGCAT
GCCAAAATGCATCGCCTCCAAGTCAAATTTGAGAATAAGTGCAGATGGAA
TAGGATCCATCAGTGGCAGATTACTTTTAGGCACTGCCGAAATTATACCC
TCTGAAGAGCTCATAGATACAACTGGTGCGGGTGATGCATTTATCGGAGC
AGTTCTCTACGGTTTATGCTCTGGCATGCCGCCTGAGAAGATGCTGCCTT
TTGCAGCTCAAGTGGCTGCTTGCGGGTGCAGGGGTTTAGGGGCTCGGACT
GCTCTTCCCCATCGCACAGATCCCCGCCTGGTTGCCTATTGACTCGAGGA
ACTGTAGTGTATCAATCTGTGTTGGATCTGATTGGGATGGATTCATTGGA
TTGTGGGCGCCTTTGAAAAATAAGAGATTAAGCATTTGAAATATGGAGTA
ATAAGAAAGCCGCCTGCAGTTGAAATCGGTTCCTAAGTTGTATGTAAACA
GTGATTGTTGTTGCATACTGTCAATATACCTTGGCTTGTGTTAATAAGAG
AGATTTGTGTGCTGTTGTTGCAAGGCCC
> SEQ ID NO:135  182206_300659_1  Papaver rhoeas, sense
TTTTTTTTTTTTTTTTGTTCTTTTTTTAATTATTATTATAATTCGTTC
ACGAGGCTGTTTTCTGAACTCAAATTACTCTTAAAGACAGGCCTCTCTC
CTCCCGTGTCACTTCTAAATTTGGAAGAGCAGAAATCCAAAAACCAAAT
GACAAATAAGCTTCAGCTGAAAAAGGGACAAAGAAAACAATCTACATAAC
TGACTTAGCTGCTGCAATAACGGCCTCTGATGTGATGCCAAACTCTTTGT
ATATAATTGGTGCAGGCGCACTTGCTCCGAAACCGTCAACACCAATAGCC
TTTCCTTTGCTTCCGATAATCTTGTGCCATCCGAATGTTGAACCTGCCTC
AATACTAACTCTAGCAGTGACAGCAGCTGGAAGAACAGACTCCTTGTATT
CGTCGGTCTGTTCATCATATAATTCCCAGGAAACAAATGAAACAACCCTA
ACTGCAGTTCCTTCCTTCCTGAGCTCACCAGCGGCCTTTTCAGCAATTTC
TAATTCTGAACCAGTAGCACACACGATGACATCTGGTTTGTTACCTGTAG
```

Figure 1kk

AGTTGTCTGATATTGTGTAACCTCCCTTGGCGACTCCTTCAATGGAGGTT
CCTGGAAGGTTTGCAAGCTTTTGACGTGAAAGGGCAAGAATTGAGGGTCT
CTTTCTGTTTTCAACTGCAACCTTGTATGCCCCGGCAGTCTCGTTTCCGT
CAGCGGGACGGAACATAAGAATGTTAGGCATGGCTCTAAAGCTTGCCAAA
TGTTCGATGGGCTGATGAGTTGGACCATCCTCTCCAAGACCAATAGAGTC
GTGGGTCATGACGTAAATGACTCCAGCTTCAGATAAGGCTGAAATTCTCA
TGGCACCTCTCATGTAATCGGTGAAAACAAAGAAGGTAGCACAGTAGGGG
ACAAAACCAGGACTGTGGAGAGCAATTCCGTTACAGATGGCTCCCATAGC
ATGCTCTCTGACACCAAATCGAACATTCCTCTCTTCTGGAGTGGCCTTTT
GGAAATCTCCGAACATTTTCATCAAGGTCATGTTGGAGGAAGCGAGATCT
GCACTACCACCAATAAGACCAGGGAGGACTGGAGCAAGTGCATTAAGGCA
TGTCTGGGATAGGTTTCTGGTGGCATCAGCTGGGATCTCTGGAGTGTAGG
TAGGAAGAGCCTTCTCGAATTC

> SEQ ID NO:136 183116_300619_1 Oryza japonica, sense
AAATCGCATCGACTTCGATGCGCTTCGTTTCGTTCTCGCTGTTGATTTGT
TCGTGAGATTTGAATTCTAGCAATGGCTCCTCTCGGTGACGGAGCGGCGG
CGGCGGCGGCGGCGGAGCCCAACCTGGTGGTGTCGTTCGGGGAGATGCTG
ATCGACTTCGTCCCCGACGTCTCCGGCGTCTCGCTGGCCGAGTCCGGCGG
CTTCGTCAAGGCTCCCGGCGGCGCCCCGCCAACGTCGCCTGCGCCATCT
CCAAGCTCGGTGGCTCCTCCGCCTTCGTCGGCAAGTTTGGTGATGATGAG
TTCGGGCACATGCTGGTGGACATCCTGAAGAAGAACGGGGTGAACGCGGA
GGGGTGCCTGTTCGACGAGCACGCGCGCACGGCGCTGGCGTTCGTGACCT
TGAAAAGCAACGGCGAGCGCGAGTTCATGTTCTACCGGAACCCGAGCGCC
GACATGCTCCTGACGGAGGCGGAGCTCAACCTGGACCTGATCCGGCGCGC
CAAGATCTTCCACTACGGCTCCATCTCCCTCATCACCGAGCCGTGCCGCT
CCGCCCACGTCGCCGCCATGCGCGCCGCCA > SEQ ID NO:137 183532_300623_1 Oryza japonica, sense
CCTGTCATAAGTTGGCATCAAAACTTAACCAATCAAGTAAAAGCACACCA
AATAAGCTGTGCCACTAATTGATTACACAAGCCCTTGATGTATCAAGGAG
TTCCAAATACAACACCTAGCAGCAGAATACTAAAATTAAAGCTACAACAG
GAAGCTTTTTGGCTTCTAATATTAGCTTTGCTCCTCGGCCTCAGCCTCCG
CTGCCGCGGCCTCCCTCTCTTCCGCGGCTGCTGCCATCAGTTCGTCAAAT
TTGTCCGTCTTGCCCAGCACTATTTCAATCTTGGCTTTCTGCATAGGGCG
ACTCCTCGAATCATCTTTGACGTCAACAGTAGATGTCATAATCTTCTTCT
CGACAGCAAGGCCATTATTTTTCAGAATTTCAGCAACAGTCACCACAGTT
GCAATAGCCATGCCGAGTGCCGAGAGCTCCACTTCGTTATGCAGCTGCAT
GTACCTCTTGGCGAGGTTGACGTAGAAGAAGAGCGGCTTCTTGGTGTTGG
AGACCTGGATGCGGTTCTTCTTGTGCGCCTCCGCCGCGCCGCCGCCCGCC
CCGGCGGCTTCTCCCGCGGCTATGGTGAGGTTGCCGACCGCCTCCGTCAC
CTCCTCCATGGCCGCCGCCCGACGAGTCCCGCGGAGCACCGTGCGCGAG
TGAAACGGAGAGCGCGAGGCGGCGAAGAAGATGTGGAGGATTTCGGCGGC
GACGGAGGTAAGAGGGA > SEQ ID NO:138 122225_300017_1 Oryza japonica, sense
CCCCCCTCATTGTGATGAGCACTGGCTCTGAACTAGAGATTGTCGCCAAG
GCTGCTGATGAGTTGAGGAAGGAGGGGAAGACTGTCCGTGTCGTGTCATT
TGTTTGCTGGGAGCTTTTCGATGAACAGTCGGCTGAGTACAAGGAGAGTG
TTCTCCCTGAGGCTGTTACTGCAAGAGTCAGCCTTGAAGCAGGGTCTACT
CTTGGATGGCAGAAGTACGTCGGAAGCAAAGGCAAGGCTATTGGCATCGA
CAAATTCGGTGCAAGTGCTCCTGCTGGAAAGATCTACCAGGAGTATGGCA
TCACCGCGGAGAACGTCATCGCAACAGCAAAGAGCCTGTAAGATTCAAAC
CGCGCGTTTTGAGTTTTTGTCATCGTTGATGCCAAGGAACAGTATACATG
AAGCCATGAAGGTCTTGTGCCCAAAGCTTGGAATAATGAAGGGAGAGGGA
TGCCTGCATTGGAGCGTGAGTGGTATTTTAGGCCTGTAATAAGCACTGCT
TTTCCATTTACGTTTGTTTTGTTGGATCACTCCTTAGATGATTCATCAAG
TTGAGCCTGATTCAATTGGGGACTGGTTTTGGTAATATTTACATTTGACT
ATAGTCCAGCTACAATATTCCGTTCTCCCT

Figure 111

> SEQ ID NO:139 122241_300017_1  *Oryza japonica*, sense
CCCCCCTCATTGTGATGAGCACTGGCTGTGAACTAGAGATTGTCGCCAAG
GCTGCTGATGAGTTGAGGAAGGAGGGGAAGACTGTCCGTGTCGTGTCATT
TGTTTGCTGGGAGCTTTTCGATGAACAGTCGGCTGAGTACAAGGAGAGTG
TTCTCCCTGAGGCTGTTACTGCAAGAGTCAGCCTTGAAGCAGGGTCTACT
CTTGGATGGCAGAAGTACGTCGGAAGCAAAGGCAAGGCTATTGGCATCGA
CAAATTCGGTGCAAGTGCTCCTGCTGGAAAGATCTACCAGGAGTATGGCA
TCACCGCGGAGAACGTCATCGCAACAGCAAAGAGCCTGTAAGATTCAAAC
CGCGCGTTTTGAGTTTTTGTCATCGTTGATGCCAAGGAACAGTATACATG
AAGCCATGAAGGTCTTGTGCCCAAAGCTTGGAATAATGAAGGGAGAGGGA
TGCCTGCATTGGAGCGTGAGTGGTATTTTAGGCCTGTAATAAGCACTGCT
TTTCCATTTACGTTTGTTTGTTGGATCACTCCTTAGATGATTCATCAAG
TTGAGCCTGATTCAATTGGGGACTGGTTTTGGTAATATTTACATTTGACT
ATAGTCCAGCTACAATATTCCG > SEQ ID NO:140 130065_300484_1  *Papaver rhoeas*, sense
GAATTCAAGAGCCATTGGAGCCGCCATACTGCTGAAGGTGCTGCCCTAGA
AGCTGAATGGACAGCTAAATTTGCAGAGTACGAAAAGAAGTACTCAGAGG
ATGCTGCAGAATTTAAGTCCATCATTACTGGTGAATTCCCTGCTGGTTGG
GAGAAGGCTCTTCCTACCTACACTCCGGAGATCCCAGCTGATGCCACCAG
AAACCTATCCCAGACATGCCTTAATGCACTTGCTCCAGTCCTCCCTGGTC
TTATTGGTGGTAGTGCAGATCTCGCTTCCTCCAACATGACCTTGATGAAA
ATGTTCGGAGATTTCCAAAAGGCCACTCCAGAAGAGAGGAATGTTCGATT
TGGTGTCAGAGAGCATGCTATGGGAGCCATCTGTAACGGAATTGCTCTCC
ACAGTCCTGGTTTTGTCCCCTACTGTGCTACCTTCTTTGTTTTCACCGAT
TACATGAGAGGTGCCATGAGAATTTCAGCTTTATCTGAAGCTGGAGTCAT
TTACGTCATGACCCACGACTCTATTGGTCTTGGAGAGGATGGTCCAACTC
ATCAGCCCATCGAACATTTGGCAAGCTTTAGAGCCATGCCTAACATTCTT
ATGTTCCGTCCCGCTGACGGAAACGAGACTGCCGGGGCATAC > SEQ ID NO:141 130517_300488_1  *Papaver rhoeas*, sense
GAATTCAAGACAGATACAGCATTAGTTGATAAATGAGTGAATACTATTAG
ATTTCTAGCAATTGATGCTGTCGAGAAAGCTAATTCAGGTCATCCTGGTT
TACCTATGGGATGTGCGCCCATGGGTCATATTTTATACGATGAAACCATG
AGATATAACCCTAAGAACCCTTACTGGTTTAACAGAGATAGATTCGTTCT
TTCTGCTGGTCACGGTTGTATGTTGCAGTATGCTTTGCTTCATCTTGCTG
GTTACGACAGTGTTACGACAGAAGATTTGAAGACTTTCCGTCAGTGGGA
AGCAAAATTCCTGGTCACCACGAGAACTTCGAGACTCCTGGTGTTGAAGT
CACTACAGGTCCCCTTGGACAAGGTATTGCTAATGCTGTTGGATTGGCAC
TTGCCGAGAAGCACTTGGCTGCCCGTTTCAACAAGCCTGACAGCGAGATT
GTAGACCATTACACATACTGTATTCTTGGAGATGGATGTCAAATGGAGGG
AATTGCAAATGAAGCTTGTTCGCTAGCTGGACATTGGGGACTTGGAAAGC
TGATTGCTTTCTACGATGACAACCACATCTCTATTGATGGTGACACAGAG
ATTGCTTTCACAGAGAGTGTAGATAC > SEQ ID NO:142 130849_300491_1  *Papaver rhoeas*, sense
GAATTCAGAAGAAGAACAGAGGAGAAGGAAAAAAGGAATCAATCCTTTAT
TCCGATAATAGCCTCAATCATGGCAGCATCTTCATCCCTTACAGTATCAC
AAGCCCTAGTTGGCAGGAAAATCTCTGGTATTAACACTTCTTCTCGTTCA
CAATCATTACCTGGATTCAGTCTAAGTACTTTATCAGGAAGAACATTGAA
ATCTTCATTGATTTCATCGATTGCATCATCACGATCTAATCGTGTCAATA
CACCATCGTTATCGAGATCGTTGGTGGTCCGTGCTTCAGCTGTTGAGACT
TTGGAAAAGACAGATACAGCATTAGTTGATAAATCAGTGAATACTATTAG
ATTTCTAGCAATTGATGCTGTCGAGAAAGCTAATTCAGGTCATCCTGGTT
TACCTATGGGATGTGCGCCCATGGGTCATATTTTATACGATGAAATCATG
AGATATAACCCTAAGAACCCTTACTGGTTTAACAGAGATAGATTCGTTCT
TTCTGCTGGTCACGGTTGTATGTTGCAGTATGCTTTGCTTCATCTT > SEQ ID NO:143 131037_300510_1  *Papaver rhoeas*, sense
GAATTCAAGACAGATACAGCATTAGTTGATAAATCGGTGAATACTATTAG
ATTTCTAGCAATTGATGCTGTCGAGAAAGCTAATTCAGGTCATCCTGGTT
TACCTATGGGATGTGCGCCCATGGGTCATATTTTATACGATGAAACCATG

Figure 1mm

AGATATAACCCTAAGAACCCTTACTGGTTTAACAGAGATAGATTCGTTCT
TTCTGCTGGTCACGGTTGTATGTTGCAGTATGCTTTGCTTCATCTTGCTG
GTTACGACAGTGTTACGACAGAAGATTTGAAGACTTTCCGTCAGTGGGGA
AGCAAAATTCCTGGTCACCACGAGAACTTCGAGACTCCTGGTGTTGAAGT
CACTACAGGTCCCCTTGGACAAGGTATTGCTAATGCTGTTGGATTGGCAC
TTGCCGAGAAGCACTTGGCTGCCCGTTTCAACAAGCCTGACAGCGAGATT
GTAGACCATTACACATACTGTATTCTTGGAGATGGATGTCAAATGGAGGG
AATTGCAAATGAAGCTTGTTCGCTAGCTGGACATTGGGGACTTGGAAAGC
TGATTGCTTTCTACGATGACAACCACATCTCTATTGATGGTGACACAGAG
ATTGCTTTCACAGAGAGTGTAGATACCCGTTTTGAAGGTCTAGGATGGCA
CGTAATTTGGGTGAAGAATGGTAACAATGGTTATGATGAAATTCGTGCTG
CCATC

> SEQ ID NO:144 131193_300511_1  *Papaver rhoeas*, sense
GAATTCAAGAATAAGAACAGAGGAGAAGGAAAAAGGAAAATCAATCCTTT
ATTCCAAAAGGCCACTCCAGAAGAGAGGAATGTTCGATTTGGTGTCAAAG
AGCATGCTATGGGAGCCATCTGTAACGGAATTGCTCTCCACAGTCCTGGT
TTTGTCCCCTACTGTGCTACCTTCTTTGTTTTCACCGATTACATGAGAGG
TGCCATGAGAATTTCAGCTTTATCTGAAGCTGGAGTCATTTACGTCATGA
CCCACGACTCTATTGGTCTTGGAGAGGATGGTCCAACTCATCAGCCCATC
GAACATTTGGCAAGCTTTAGAGCCATGCCTAACATTCTTATGTTCCGTCC
CGCTGACGGAAACGAGACTGCCGGGGCATACAAGGTTGCAGTTGAAAACA
GAAAGAGACCCTCAATTCTTGCCCTTTCACGTCAAAAGCTTGCAAACCTT
CCAGGAACCTCCATTGAAGGAGTCGCCAAGGGAGGTTACACAATATCAGA
CAACTCTACAGGTAACAAACCACATGTCATCGTGTGTGCTACT > SEQ ID NO:145 131364_300513_1  *Papaver rhoeas*, sense
GAATTCAAGAACATTGAAATCTTCATTGATTTCATGGATTGCATCATCAC
GATCTAATCGTGTCAATACACCATCGTTATCGAGATCGTTGGTGGTTCGT
GCTTCAGCTGTTGAGACTTTGGAAAAGACAGATACAGCATTAGTTGATAA
ATCAGTGAATACTATTAGATTTCTAGCAATTGATGCTGTCGAGAAAGCTA
ATTCAGGTCATCCTGGTTTACCTATGGGATGTGCGCCCATGGGTCATATT
TTATACGATGAAACCATGAGATATAACCCTAAGAACCCTTACTGGTTTAA
CAGAGATAGATTCGTTCTTTCTGCTGGTCACGGTTGTATGTTGCAGTATG
CTTTGCTTCATCTTGCTGGTTACGACAGTGTTACGACAGAAGATTTGAAG
ACTTTCCGTCAGTGGGGAAGCAAAATTCCTGGTCACCCCGAGAACTTCGA
GACTCCTGGTGTTGAAGTCACTACAGGTCCCCTTGGACAAGGTATTGCTA
ATGCTGTTGGATTGGCACTTGCCGAGAAGCACTTGGCTGCCCGTTTCAAC
AAGCCTGACAGCGAGATTGTAGACCATTACACATACTGTATTCTTGGAGA
TGGATGTCAAATGGAGGGAATTGCAAATGAAGCTTGTTCGCTAGCTGGAC
ATTGGGGACTTGGAAAGCTGATTGCTTTCTACGATGA > SEQ ID NO:146 167345_300546_1  *Papaver rhoeas*, sense
GAATTCACATTGAAATCTTCATTGATTTCGGCGATTGCATCATCACGATC
TAATCGTGTCAATACACCATCGTTATCGAGATCGTTGGTGGTTCGTGCTT
CAGCTGTTGAGACTTTGGAAAAGACAGATACAGCATTAGTTGATAAATCA
GTGAATACTATTAGATTTCTAGCAATTGATGCTGTCGAGAAAGCTAATTC
AGGTCATCCTGGTTTACCTATGGGATGTGCGCCCATGGGTCATATTTTAT
ACGATGAAACCATGAGATATAACCCTAAGAACCCTTACTGGTTTAACAGA
GATAGATTCGTTCTTTCTGCTGGTCACGGTTGTATGTTGCAGTATGCTTT
GCTTCATCTTGCTGGTTACGACAGTGTTACGACAGAAGATTTGAAGACTT
TCCGTCAGTGGGGAAGCAAAATCCCTGGTCACCCCGAGAACTTCGAGACT
CCTGGTGTTGAAGTCACTACAGGTCCCCTTGGACAAGGTATTGCTAATGC
TGTTGGATTGGCACTTGCCGAGAAGCACTTGGCTGCCCGTTTCAACAAGC
CTGACAGCGAGATTGTAGACCATTACACATACTGTATTCTT > SEQ ID NO:147 167687_300549_1  *Papaver rhoeas*, sense
GAATTCAAAGCTGATTGCTTTCTACGATGACGACCACATCTCTATTGATG
GTGACACAGAGATTGCTTTCACAGAGAGTGTAGATACCCGTTTTGAAGGT
CTAGGATGGCACGTAATTTGGGTGAAGAATGGTAACAATGGTTATGATGA
AATTCGTGCTGCCATCAAGGAAGCAAAGTCTGTCACAGACAAGCCCACTT
TGATCAAGGTGACTACCACCATTGGTTTTGGTTCTCCAAACAAGGCAAAC

Figure 1nn

```
TCATACGCCGTACACGGTGCTGCATTGGGTTCTAAAGAGGTTGATGCCAC
AAGGAAGAACCTTGACTGGCCATTTGAGCCTTTCCACGTGCCAGAGGATG
TTAAGAGCCATTGGAGCCGCCATACTGCTGAAGGTGCTGCCCTAGAAGCT
GAATGGACAGCTAAATTTGCAGAGTACGAAAAGAAGTACTCAGAGGATGC
TGCAGAATTTAAGTCCATCATTACTGGTGAATTCCCTGCTGGTTGGGAGA
AGGCTCTTCCTACCTACACTCCAGAGATCCCAGCTGATGCCACCAGAAAC
CTATCCCAGACATGCCTTAATGCACTTGCTCCAGTCCTCCCTGGTCTTAT
TGGTGGTAGTGC
> SEQ ID NO:148  167907_300552_1  Papaver rhoeas, sense
CAGAGATAGATTCGTTCTTTCTGCTGGTCACGGTTGTATGTTGCAGTATG
CTTTGCTTCATCTTGCTGGTTACGACAGTGTTACGACAGAAGATTTGAAG
ACTTTCCGTCAGTGGGGAAGCAAAATTCCTGGTCACCCCGAGAACTTCGA
GACTCCTGGTGTTGAAGTCACTACAGGTCCCCTTGGACAAGGTATTGCTA
ATGCTGTTGGATTGGCACTTGCCGAGAAGCACTTGGCTGCCCGTTTCAAC
AAGCCTGACAGCGAGATTGTAGACCATTACACATACTGTATTCTTGGAGA
TGGATGTCAAATGGAGGGAATTGCAAATGAAGCTTGTTCGCTAGCTGGAC
ATTGGGGACTTGGAAAGCTGATTGCTTTCTACGATGACAACCACATCTCT
ATTGATGGTGACACAGAGATTGCTTTCACAGAGAGTGTAGATACCCGTTT
TGAAGGTCTAGGATGGCACGTAATTTGGGTGAAGAATGGTAACAATGGTT
ATGATGAAATTCGTGCTGCCATCAAGGAAGCAAAGTCTGTCACAGACAAG
CCCACTTTGATCAAGGTGACTACCACCATTGGT
> SEQ ID NO:149  175736_300544_1  Oryza japonica, sense
CGATCGCTTCTCATCGCAAATCGCATCGACTTCGATTCGCTTCGTTTCGT
TCTCGCTGTTGATTTGTTCGTGAGATTTGAATTCTAGCAATGGCTCCTCT
CGGTGACGGAGCGGCGGCGGCGGCGGCGGAGCCCAACCTGGTGGTGT
CGTTCGGGGAGATGCTGATCGACTTCGTCCCCGACGTCGCCGGCGTCTCG
CTGGCCGAGTCCGGCGGCTTCGTCAAGGCTCCCGGCGGCGCCCCGCCAA
CGTCGCCTGCGCCATCTCCAAGCTCGGTGGCTCCTCCGCCTTCGTCGGCA
AGTTTGGTGATGATGAGTTCGGGCACATGCTGGTGGACATCCTGAAGAAG
AACGGGGTGAACGCGGAGGGGTGCCTGTTCGACGAGCACGCGCGCACGGC
GCTGGCGTTCGTGACCTTGAAAAGCAACGGCGAGCGCGAGTTCATGTTCT
ACCGGAACCCGAGCGCCGACATGCTCCTGACGGAGGCGGAGCTCAACCTG
GACCTGATCCGGCGCGCCAAGATCTTCCACTACGGCTCCATCTCCCTCAT
CACCGAGCCGTGCCGCTCCGCCCACGTCGCCGCCATGCGCGCCGCCAAGT
CGGCCGGCATCCTCTGCTCCTACGACCCC
> SEQ ID NO:150  23242_301102_1  Arabidopsis thaliana, sense
CTCAATGGAGTACAAACATTTCAGCCATCCACACACTCTAAAACTCCAAC
AGATTCAGCCACATAAAAGCTCAGATTCTTCAGTAATCTGCTCAGGTTGT
GAATCAGCCATCTCTGAATCCGAAACCGCGTATATCTGTTCAACATGTGA
CTTCAATCTTCATGAGCAATGTGGTAACGCAGTGCGTGGGATGCAACATC
CTTCTCACGCTGGTCTCCACCACTTGACTCTAGTCCCTTACACAACTTAC
AGCGCTGGTACCTTCCTCTGCAGAGCCTGTGGCTGCACTGGAGGTAAAGG
GTTCTCTTACTGTTGTCCTTTGTGTGACTTTGACCTTCATGTTCAATGCG
CTCACCTGCCTCAGGTCTTGGTTCATGAGTCTCATCCTATGCATAGTCTT
CTTCTTGTCTACAACAGTACTCCTCCTATGTCTTTTACTCAGTTTGGTTT
CGGGAATCAGCTTGTTTGCAATCTTTGTAATATGACTATGGATGGTAGGT
TTTGGTCTTACAACTGTTATGCTTGTAACTATCATATTCATGCTTCATGT
GCTGTGAATAAGCCCAATCCAGTGGCTGCTTCTGCTGAGAACTGTGGGGC
GAGTGATGAAGGAAAGACACCGACTGCTGAATCTGTTCCTGTTCAGGGTT
TGGAGACTGAGCAGACGGAACAAGTAGCTGCAATAACAGAGCAAGTGGAA
GATCCAGTTTTGAGGCAACAGCTTGAGCTTCAGAAGCTTCAGCTTGAGCT
AGATATGAGTTCTGCTCTCGCAAACATGATTGGTTCCTTCAATCTCAGTT
CTTTCGTTTGAAGTGTCTTTGTGTTTCAGTTTGTTTGATTTTATGCATTT
ACATGTGTTGAATTGTCTCTGTTCTTGTGTTCCCTAATGTGCTTCTGATT
TGAATAAATATATCCTATCTATTTGGTTTAAAAA
> SEQ ID NO:151  23869_301102_1  Arabidopsis thaliana, sense
CTCTTTCCTTCTCTCACCGCGAGAGTAACCGAGAGACATGATTCTGATAA
ACTCTAATTCTCCGACGCTAATCTCAGCCGTTAGATTCGTGGGCTCATCT
```

Figure 1oo

CCGTTCACCACTCGGGGGCTTTCTCAGTCCACTGTCTCAATCTCTAGAAA
CAAAAGCTTCTTCTTCCACTTCACCGAGACGAAGGAGAAGAACGCAAGAA
GAGATTATTTGAGAGTATCAATCGTGTGTGACGCAGGAGGGATGTTTCCG
GTGGATCCATGGGCTCCAACCATTGATTCACAGAGCATAGCATCACAACT
CTTCGCTGTATCTCTGTTTCCTTACATTGGCTTTCTCTATTTCCTCACTA
AATCCAAATCAGCTCCAAAACTCACACTTTTCGGTTTCTACTTCTTGCTT
GCCTTCGTTGGAGCTACAATTCCAGCTGGATTTATGCTAAGGTGCATTA
TGGAACATCGTTGTCGAATGTTGATTGGTTACACGGAGGAGCTGAATCAC
TTCTTGCTCTTACCAATTTGTTTATCGTGTTGGGTCTTAGACAAGCTCTG
AGGAAGTCTCAAGATGATGATGATGATAAACTTGGTAATGATGATGAAGT
TCCAACAACTCAAGAACAAGGGAAATCTTCAGTGTAGTAAAACAAATGTA
AATTTTTAATTATGGAGTTTCACTTGTTTTTTAATTAGATTATATATAG
TCGACGCCCATCTAATTCCCATTTTAG
> SEQ ID NO:152  25162_301104_1
TTAAACCAAAGCATACTCTTTTGCCAGAGAATCATCAAGACATGACGATT
ATTTCAATGGTGACTCTATCAGGGAACCAAGAAACTATGATAACAATTTG
GAAGCTCCTACAAGAAACACTCTGGTACAATCCCTCCAATGGAGAGAGAA
AACACCTACTCAGGACAATCCAATCTTTGAAACCTCCCAGTCCTCCAGAG
TCAGGCGCCCACCTCTTGAGAGACAGCAGTCGACACTCTAACCCTCACAA
CTTCGCCTCTCATCCCAACTACAGAAGCCGTAATGGGAGAACTCTGTGAT
GTCACTATTCAATACACGAGCTGCGCCGATCCTAGCAATTCCCTCTCCTT
TTGATAACCATTTCTCTGTAGAACAGCCTCTCTCTCCTGATGTGCCAGTA
CATCCTGCTCAGATACAACAGATCCCTCCGATCCCACCAAAGAAAAAGAA
GGGCCGACCTCCACTTACAAAACCTATTAGACGCCATGGTGATGACTCTG
TCAGCACTTCAAGTAAATCCTCTTCTCAGAGACGACAACACACCAGGGTT
GCAGCAAATCTGGCTTCTTCAAGCAAAGCTCCTCCTACAAGGCCAATTAT
CCCAGCCACTGTGAAAGGAAGGGTGGATTTTCCCAATCCACCTCCTCCTC
TTCCTTAAAACTTGCAAGCTGGAACTGCTGTGGGCTGGGGAATCCCATGA
CAGTTCAACGACTGAGAGAGATTCAGAAAACAATCTCTCCAGACATCCTA
TTCCTCATGGAGACGAAAAACCCTGATGAAGTGGTGCTTAAAAAACTTCA
ATGGTCGAATTTCTCAAACCATTTACTCATATCTCCGCACAGCCCTGGGG
GTGGAGGCCTGGCCCTCTACTGGAAACAACACATCGAGCTAGAAGTACTC
TCC
> SEQ ID NO:153  25979_301104_1
TTGTTTTTTTTTTGTTTTTTTTTTTTTTTTTTTTTAAGAAAGGCGATTT
GCTCACCATAATCACAACATATTCAAGAACCAAAGACAACGAGGTGACAT
AAAAAAACACCAAAAAAGGGACTCAAAACATGAAGAAACAAAAGAGAAGA
AACAAGAAACTTGAAGAAACAAGGCCATTAACTCCGAATGCATAAGCTCC
TGAGTTAGTAGTTGTTAAAAGAGAATAGCCGCCTTCCGGTGTGTTTGTAG
TGAGGATGACAACAACCCAAATATCACCAGAACCAATACCAATTCCAGTG
ATCTTAGAATCATTCAAGTTCTTGAGTACGACACTGTTGAAATTGCTCAA
GTCAGGGTTCTTATCATGCTTAGGAAAACAGACTTGCATGATCACACCGT
CTCTGACTACGGTTGTGTTGAGACTGCATTTAGCGAGGAGGTTATTTCCA
GGGACTGGAGCTGAGTTATTAGTGTTTGTGCAGGGTTGGTTCTTTAGTTG
GTCTACGACTTCGTCTGCGAGACATTCTGCGTTTTCGTTCTTTGTTAAGG
TTTTTAGGTTTAGTCCTGTTCTGTATTTGTTGAATACTGTAAGAAGAAGG
TCTTCTTCTCCATCGGTGCCGGAAAGAACAAGACGATGAAGGGAGAGAAA
GACTGAGAGAAGACAGAGTAGATGGAGTTTGGAAATCGCCATTGATGCAG
AGGTTTTTTTTTTT
> SEQ ID NO:154  25146_30007
GAAGGTGATAAGGAGCATTTGATGTCTGAAATGAACTTTGAGAAAACATT
TGGGCAATCATCCATCTTTGTAACCTCAACTTTGATGGAAGAAGGTGGTG
TTCCTCCGTCATCAAGTCCTGCAGGTACCGGTCCGGAATTCCCGGGTCGA
CCCACGCGTCCGCTTATCCGTTAAAAGACTAGAAAAGGGATCAACCAA
ACCAAACCAAAAAAAAGTAACCATCTTTCTCCTAAATCTCTACAATGG
CTCGATCTTTATCTCCATCACTTTCTCTCTCGGTGCCGTTTCGCCGCA
GCTTCTCTTCTTCTCCCTTCATCTCAAACCATTTTCATCCGATCTCAATC
CTCGAATCGTCGGTCTAACTCTAACCATCTCGGAGTAATCTACGAGATTG

Figure 1pp

ATATCGCTGCGGATCCTCTTGTCAATAAGTTGGAAGATGCTGTCCACCGG
ATTATGGTACGCCGATCCGCACCTGATTGGCTCCCTTTTGTTCCCGGTGC
TTCCTTTTGGGTTCCACCTCCTAGATCCCAGTCTCATGGGATCGCTAAGC
TCGTTGAGAAGCTGGCCAATCCGATCTCTGATGAAGAATCTATNTCAATC
TCATCGGTTCGAGGATGGCCTTGCTCTGATACTTCATAAGGTGTAAGCC
TCATCAGTGAGACGAGATGACTCATACTGATATACTCGAGACG

SEQ ID NO:279

CTTCTTCAGGGTTCAGGTGTGAAAGCTGACGCCACCGTGGCAGCTGACGG
TAGCGGTACATTTAAAACTGTGGCTGCTGCGGTTGCCGCGGCCCCTGAAA
ATAGTAATAAGAGGTATGTGATACATATAAAAGCCGGAGTTTACAGAGAG
AATGTGGAGGTTGCTAAGAAGAAAAGAATATAATGTTTATGGGAGATGG
TCGGACGAGAACTATTATCACCGGAAGTCGAAACGTTGTAGACGGTAGCA
CCACTTTCCACTCCGCCACCGTTGCTGCTGTCGGCGAGAGATTCTTAGCT
CGTGACATCACTTTCCAAAACACGGCGGGTCCGTCGAAGCACCAAGCGGT
GGCTCTCCGTGTGGTGTCTGATTTCTCCGCCTTCTACAATTGCGACATGT
TAGCTTATCAAGACACTCTATACGTCCACTCTAACCGTCAATTCTTCGTC
AAATGTCTCATCGCCGGAACCGTTGACTTCATCTTCGGAAACGCCGCCGT
CGTGCTCCAAGACTGTGACATCCACGCTCGCCGCCCTAATTCCGGTCAGA
AAAACATGGTCACAGCTCAGGGAAGAACGGATCCTAACCAGAACACAGGG
ATCGTTATCCAGAAATGTAGGATCGGTGCCACGTCGGATTTACAGTCGGT
GAAGGTAGTTTTCCGACGTACTTGGGTCGGCCATGGAAGGAATATTCAC
AAACGGTGATAATGCAGTCGGCTATCTCCGACGTGATCCTTGTCGACGCC
TCAAGGACAAGAACTCTTACATGATATACACAGTTGTTGGGTGTCTCGGA
ATTGCTGCCTTAAGTGATCTTGTCAATGAGGTGGTAGCAATTGAGACCTG
TGGAGGTCAGGTGACTGCTGATGGCACTAGGAAACGGCAAAGTGGTGGTG
TATTGTGGAACATCATCAAAGCGAGACAGCCTGAAGCTTATAGAGAGATA
ATGAAAAAGACCAAGGAGTTTGAGAAACAATTTAGGCAACCAAACACGAG
ACCAAAATCAGGGCCCAAAAGAGATCAGGGTAGCTCCTCCGAAGGAGTTG
CCTCTGGAAATGTATCTGCTGATGAAGCTCTGGTGAGCGAGATGTGTGTT
ATGCCGGTAGCTGACCAGACTGAATCCAACGGGAAAAGGAAAGGAAATC
TGTTCATGAGAGGATCAGGGTACCTGTTTCATATGATGACCTTTTCAGAG
ATGCACCTTTAGATGATTCTCTAGCACATCATTCTTCTGCTTAAGCTCAT
TACTGGATGACTTCTCTTGTGGAAAGCAATTGTTTTGTCGAGAAATGGAA
AGCATTGATTTTGT

Figure 2a

SEQ ID NO: 155 contig01 *Arabidopsis thaliana*

GGAAAACAATCACCTGGTTGTTTGTTTCGGGGAGTTGTTGATTGACTTCG
TTCCTACTGTATCTGGAGTTTCACTTGCAGAAGCGCCTGGATTTGAGAAA
GCTCCTGGTGGAGCTCCAGCTAACGTTGCAGTTGGTATAGCAAGATTAGG
AGGTTCTTCCGCCTTTATTGGCAAGGTGGGTGCAGATGAATTTGGTTATA
TGTTATCTGATATATTAAAACAGAACCATGTCGACAATTCTGGCATGCGT
TTCGATACCCATGCAAGGACAGCATTAGCATTTGTCACTTTGAGAGCAGA
TGGCGAGAGAGAATTCATGTTTTTCCGCAATCCAAGTGCTGATATGCTTC
TTACAAAGGAAGAGCTGGACAAAGATCTCATTCAGAAGGCAAGAATATTT
CACTATGGGTCAATCTCTTTAATCGCGGAACCGTGTAGGTCAGCTCATCT
TGCAGCCATGGAGATTGCCAAAAAAGCTGGCTGCATTCTCTCTTATGACC
CAAATCTAAGGTTGCCCTTATGGCCATCCGCAGATGCTGCTCGTAAAGGC
ATCTTGAGCATTTGGGACCAAGCCGACGTTATTAAGGTAAGCGAAGACGA
AATCACATTCTTGACAGACGGTGAAGACGCCTA

> SEQ ID NO: 156 contig02  *Oryza japonica*

CCCCATGACATTGCTTAAGATGTTCGGTGACTTCCAAAGGGATACGCCTG
AGGAGCGCAATGTCCGATTTGGAGTCAGGGAGCATGGAATGGGCGCCATT
TGCAACGGCATTGCTCTGCACAGCCCAGGACTCATTCCATACTGGGCTAC
TTTCTTTGTTTTCACTGATTACATGAGAGCTGCCATGAGGATCTCAGCCT
TGTGTGAAGCCGGAGTTATCTATGTTATGACCCATGACTCTATTGGTCTT
GGAGAAGATGGTCCAACCCATCAGCCCATTGAGCACTTGGTGAGCTTCCG
TGCGATGCCCAACATTCYSMYGCTTCGTCCTGCTGATGGTAACGAGACTG
CTGGGGCATACAAAATCGCGGTSCTCAACAGGAAGAGGCCATCCGTCCTT
GCTCTCTCCAGGCAAAAGCTTGCTCAGCTGCCTGGTACCTCGATTGAGGG
TGTTGAGAAGGGTGGGTACATCGTCTCTGACAACTCAACTGGCAACAAGC
CYSMCYTCATTGTGATGAGCACTGGCTGTGAACTAGAGATTGTCGCCAAG
GCTGCTGATGAGTTGAGGAAGGAGGGGAAGACTGTCCGTGTCGTGTCATT
TGTTTGCTGGGAGCTTTTCGATGAACAGTCGGCTGAGTACAAGGAGAGTG
TTCTCCCTGAGGCTGTTACTGCAAGAGTCAGCCTTGAAGCAGGGTCTACT
CTTGGATGGCAGAAGTACGTCGGAAGCAAAGGCAAGGCTATTGGCATCGA
CAAATTCGGTGCAAGTGCTCCTGCTGGAAAGATCTACCAGGAGTATGGCA
TCACCGCGGAGAACGTCATCGCAACAGCAAAGAGCCTGTAAGATTCAAAC
CGCGCGTTTTGAGTTTTTGTCATCGTTGATGCCAAGGAACAGTATACATG
AAGCCATGAAGGTCTTGTGCCCAAAGCTTGGAATAATGAAGGGAGAGGGA
TGCCTGCATTGGAGCGTGAGTGGTATTTTAGGCCTGTAATAAGCACTGCT
TTTCCATTTACGTTTGTTTTGTTGGATCACTCCTTAGATGATTCATCAAG
TTGAGCCTGATTCAATTGGGGACTGGTTTTGGTAATATTTACATTTGACT
ATAGTCCAGCTACAATATTCCGTTCTC

> SEQ ID NO: 157 contig03 *Papaver rhoeas*

GAATTCAGAAGAAGAACAGAGGAGAAGGAAAAAAGGAATCAATCCTTTAT
TCCGATAATAGCCTCAATCATGGCAGCATCTTCATCCCTTACAGTATCAC
AAGCCCTAGTTGGCAGGAAAATCTCTGGTATTAACACTTCTTCTCGTTCA
CAATCATTACCTGGATTCAGTCTAAGTACTTTRWMWGVAAGAACATTGAA
ATCTTCATTGATTTCATCGATTGCATCATCACGATCTAATCGTGTCAATA
CACCATCGTTATCGAGATCGTTGGTGGTTCGTGCTTCAGCTGTTGAGACT
TTGGAAAAGACAGATACAGCATTAGTTGATAAATCAGTGAATACTATTAG
ATTTCTAGCAATTGATGCTGTCGAGAAAGCTAATTCAGGTCATCCTGGTT
TACCTATGGGATGTGCGCCCATGGGTCATATTTTATACGATGAAACCATG
AGATATAACCCTAAGAACCCTTACTGGTTTAACAGAGATAGATTCGTTCT
TTCTGCTGGTCACGGTTGTATGTTGCAGTATGCTTTGCTTCATCTTGCTG
GTTACGACAGTGTTACGACAGAAGATTTGAAGACTTTCCGTCAGTGGGGA
AGCAAAATTCCTGGTCACCCCGAGAACTTCGAGACTCCTGGTGTTGAAGT
CACTACAGGTCCCCTTGGACAAGGTATTGCTAATGCTGTTGGATTGGCAC

Figure 2b

```
TTGCCGAGAAGCACTTGGCTGCCCGTTTCAACAAGCCTGACAGCGAGATT
GTAGACCATTACACATACTGTATTCTTGGAGATGGATGTCAAATGGAGGG
AATTGCAAATGAAGCTTGTTCGCTAGCTGGACATTGGGGACTTGGAAAGC
TGATTGCTTTCTACGATGACAACCACATCTCTATTGATGGTGACACAGAG
ATTGCTTTCACAGAGAGTGTAGATACCCGTTTTGAAGGTCTAGGATGGCA
CGTAATTTGGGTGAAGAATGGTAACAATGGTTATGATGAAATTCGTGCTG
CCATCAAGGAAGCAAAGTCTGTCACAGACAAGCCCACTTTGATCAAGGTG
ACTACCACCATTGGTTTTGGTTCTCCAAACAAGGCAAACTCATACGCCGT
ACACGGTGCTGCATTGGGTTCTAAAGAGGTTGATGCCACAAGGAAGAACC
TTGACTGGCCATTTGAGCCTTTCCACGTGCCAGAGGAWKTYAAGAGCCAT
TGGAGCCGCCATACTGCTGAAGGTGCTGCCCTAGAAGCTGAATGGACAGC
TAAATTTGCAGAGTACGAAAAGAAGTACTCAGAGGATGCTGCAGAATTTA
AGTCCATCATTACTGGTGAATTCCCTGCTGGTTGGGAGAAGGCTCTTCCT
ACCTACACTCCAGAGATCCCAGCTGATGCCACCAGAAACCTATCCCAGAC
ATGCCTTAATGCACTTGCTCCAGTCCTCCCTGGTCTTATTGGTGGTAGTG
CAGATCTCGCTTCCTCCAACATGACCTTGATGAAAATGT:TCGGAGATTT
CCAAAAGGCCACTCCAGAAGAGAGGAATGTTCGATTTGGTGTCAGAGAGC
ATGCTATGGGAGCCATCTGTAACGGAATTGCTCTCCACAGTCCTGGTTTT
GTCCCCTACTGTGCTACCTTCTTTGTTTTCACCGATTACATGAGAGGTGC
CATGAGAATTTCAGCTTTATCTGAAGCTGGAGTCATTTACGTCATGACCC
ACGACTCTATTGGTCTTGGAGAGGATGGTCCAACTCATCAGCCCATCGAA
CATTTGGCAAGCTTTAGAGCCATGCCTAACATTCTTATGTTCCGTCCCGC
TGACGGAAACGAGACTGCCGGGGCATACAAGGTTGCAGTTGAAAACAGAA
AGAGACCCTCAATTCTTGCCCTTTCACGTCAAAAGCTTGCAAACCTTCCA
GGAACCTCCATTGAAGGAGTCGCCAAGGGAGGTTACACAATATCAGACAA
CTCTACAGGTAACAAACCASATGTCATCGTGTGTGCTACTG
```

> SEQ ID NO: 158 contig04 *Oryza indica*

```
CGATGGTACGCATCATCGGGCCAAGTCCAGCTCAATCCTCCTCACCAACA
CCAAGACGACCACGACCTCCTCGCCCTCGCCGCCGCCCACCGACCATGGC
CTCCGCCGCCGCTTCTTCCTCCAAACCTCCCGTCGTGCTTGGCTGCGGCG
CCGTCTCCGCGGACTACCTCGCCACCGTCGCCTCCTTCCCCAACCCCGAC
GACAAGATCCGAAGCCTAACGCTCAAGGTCCAGGGAGGCGGCAACACTGG
CAATGCCTTGACCGCCGCTGCTCGTTTGGGCCTTCGCCCAAGGATCATAT
CCAAGGTATCCAATGACCCACAAGGAAGAAATATTCTCAAGGAGCTGCAA
GATGATGGGGTCGACACCTCTCATATCCTGGTTGCAGAGGAGGGGAATTC
ACCTTTCACCTATATAATTGTTGACAACCAGACGAAAACTCGTACTTGTA
TTCACACTCCTGGTTATCCTCCTATGGTCCCTGAAGAGCTCACACAAGAA
AACTTGTTTGCCGCTTTAGACGGTGCTGACATTGTATATTTTGATGTCAG
ATTGCATGAAACTGCTTTACTAGTTGCTGAAGAGGCAAGCCAAAGAAAAC
TTCCTAT
```

> SEQ ID NO: 159 contig05 *Arabidopsis thaliana*

```
ACCTCCAGCCCTGATGATGGTGTATGGAATACCGGAATCAGCCAAGTATT
GCTCAGCCTTTCTCTTCCAGACCAGAATGTTAGCATTGCCAATACTATTG
AGAGGGTGATTAATGTTTGTTCCTCCCATCGACCCAACCAAAACAATCTG
CTTAACTCCTGCAGAGACAGCCTTAAAAGAGTAGATTCAGGTGATCTCTG
GATGTTTTTGGACCAAAACGATACAGTGAATCTCACTGCAATCGCTAGAG
AGAACCAGAAACGATTGTTTATGTACATTGAGAAGTTACCACTAGTGGTT
CCAGATCAAGTGTATGCGTCTTCTCCTTACGATTTCCATGTGAGATGAAG
GCGGAAAACCGGTTCTGGTAAATCTTTATCTGTATACTTGGGGAAAAGGA
GGACTTGTTTTGTAAATGTATTAGAGTTAGTACAAGTAGTAGTAATCAGT
CA
```

Figure 2c

> SEQ ID NO: 160 contig06 *Arabidopsis thaliana*

ATTAGGAATAAGGCGCGTGCTTTCCAGGTTCTGCGAGCAAAACTGTATGA
AATAAAAGTAAGGGAACAACAAGAGAAGATAAGGAATGAAAGGAAATCTC
AGGTTGGGACTGGAGCTCGTTCAGAAAAGATAAGAACATACAATTATAAG
GACAGTAGAGTGACTGATCATAGGCTAAAGATGAACTTTGCGCTTACAAC
ATTTCTTGACGGTGCTTTAGAGGACGCAGTGCAGGCTTGTGCTGCTTTGG
AGCAAAAGGAACTCATGGAAGAACTCTCCGAGTCTGTAGCTGCTTCTTCT
GCTACTTCTGGATAAATCCTCAAACTATACTCCAAGGAAAACTTTGTAGT
TGTACACACATCATAATTATAAGACTTTTATTCATTCAAAA

> SEQ ID NO: 161 contig07 *Arabidopsis thaliana*

ATAGACATGTTTCTTCGCGGTCACCACATAGGGAGCATTCTCAGCACAAG
AACACTCTCTACTCTTCTCATGACAAATCCAGGTCGAAGCGGTCAAGGTC
CAGATCAAGATCCCCCACAGGCGCCATCGTAAATGAACACTCTAGCAAA
CTGGTCTGAGACTGTACCCGGGACAATATTGTGCGCGGTGGATCACAGGA
TTGGGTTAATGTACTGGACGGACATCGATATAATCAAAAACTATAAAGTC
ACCGGTTTGTGAGCGAAATAGTGCATAGTAAACCGCTCTTTCCTTAGTTC
TTCAGAAGAAATATCCAAAGATTTTTGACTGACTTGTTTGACAATATCGT
TGGTTGGTTAAGCGTTCCTATGTAAAATTTTGTTCCCTCTGAAAAAA

> SEQ ID NO: 162 contig08 *Arabidopsis thaliana*

GTACAATGTCTCCTATGTCTACCATGCCCTAGATGCCTACATCGAGAGAG
ACAATGTCGGCTTGAAAGGTTTCACCAAGTCAGTTTCTTTAGTCTAAAGG
AAAACCGTATTTGTGTCTCTTCAGCTGGTGGATCATCTTTTTGTTATTGT
TGAGGGTTTAACGCTAATAGGTTCTTTAACGATTCAAGTCTTGAAGAACG
AGGTTATGCTGAGAAGTTTATGGAGTATCAGATGCATTGTTTGCGATGGA
GCTTGCACTGACTTTGGAGAAACTTATTAATGAAAGCTTCTGAAGTTAC
AAAGTGTTGGTGTGAAGAACAATGATGTTAAGCTGGTTGATTTTGTAGAA
TCTGAGTTTCTAGGCGAGCTGGTCGAAGCCATCAAGAAAATCTCAGAGTA
CATAGATGGAACAAAAATAAGGTCAATGCAGTGGTGAAGCTGAGATCGGA
TGTTTCTGATATAAGCTGGCAAGTGAAGATGGAGGGTCAAAGACTAACCC
AAGGCTGGCAAAAGTTCGCAACAAGCCACGATCTCCGAGTCGTCGACATA
GTTGTTTTCAGACATGATGGAGATTTCTTCTCAAAACTTTGAATTCTTTG
AATTCTTTGTTTCGAGATCTATCGATACTCGACATCAAAGAACTCCTTAT
AACTCTTGATTCATTGAAACAAGAGTAGGCATGTCAATCGAGCTATCCCG
GTCCGACCCGAAACCCGTAATACCCGTATATGTTTGAGTTTGGGTCAGAA
AAGCTCGAGCCTATATTTTAAATTAGGTATTTCCTGGATTTTTTATTTT

> SEQ ID NO: 163 contig09 *Arabidopsis thaliana*

GATTCGATAAGAAGAATCTACATGGCTCGACATATCATGGAGAAGTTCAT
CGTCGCAGGAGCGGAAATGGAATTGAACTTATCTCATAAACCCGACAAG
AGATCTTAACCACTCAAGATCTAACTCACACTGATCTCTTCAAGAACGCA
TTAAACGAAGTCATGCAATTGATCAAGATGAACTTGGTAAGAGATTACTG
GTCATCCATCTACTTCATCAAGTTCAAAGAAGAAGAAAGCTGCCACGAGG
CAATGCATAAGGAAGGATACAGTTTTTCATCTCCAAGACTGAGTTCAGTT
CAAGGCTCTGATGATCCTTTCTATCAAGAACATATGTCAAAGAGTTCCAG
ATGCAGTAGTCCCGGTTAAGGAGTCTAAAACTGGTACTAGACCAGAACCC
AAACCAATGTTCATAGCAATCCAATCCATGTAATCTTCCTTCACATTTCT
TGTACATGTCATTTTCTCTTGTTATACCTAACTGTAAGAGAAAATGTC
CGGTTCGGATTTTGGTTTAGTTTTAAATGTGTATACCGGACAAAAACTAT
GGAACCATACTAATTAATATCTCGAAGA

Figure 2d

> SEQ ID NO: 164 contig10  *Arabidopsis thaliana*

AGAAACGATGAGTTCTCAGATTTCGGAGATTGRACAAGAGCAGCTGATCG
AGAAGCTTGAGATCTTCAAGATCCATGGCAGAGACAAACGTGGCCGTAAG
ATCCTTCGTATTATCGGAAAATTCTTCCCAGCTCGATTTCTGTCACTGGA
TGTGTTGAAGAAGTATCTAGAGGAGAAGATATTTCCTCGATTAGGTAGAA
AACCATTCGCCGTACTCTACGTCCACACCGGCGTACAGAGAAGCGAGAAC
TTCCCAGGTATCTCAGCTCTACGAGCGATCTACGACGCAATTCCGGTAAA
CGTCAGAGACAATCTTCAGGAGGTTTACTTCCTCCATCCAGGTCTTCAAT
CACGTCTCTTCCTCGCCACCTGCGGCCGATTTCTATTTTCCGGCGGGTTG
TACGGGAAGCTGAGGTACATAAGCAGAGTTGATTATCTGTGGGAACATGT
GAGGAGGAATGAGATAGAGATGCCGGAGTTTGTATACGATCACGATGATG
ATCTGGAGTATCGTCCGATGATGGATTACGGTCAAGAAAGCGATCACGCG
AGGGTTTTCGCCGGAGCCGCCGTGGATTCATCAGTCTCAAGTTTCTCCAT
GAGGTGTATCTCATAGCGTAAAAGGCTAAAACTCCACCCACTAGATATCG
GATCGTATCTTATAAACCATATAATATACGAATACGATTAATAATATATC
AAAAAGATTGGAAATAGGTGTGCTTTTTGAAATTAGTGAGCGTTTTTTAT
GGAAAAGAAAAGAAAAGAAAG

> SEQ ID NO: 165 contig12  *Oryza japonica*

CCCCCGATCGCTTCTCATCGCAAATCGCATCGACTTCGATTCGCTTCGTT
TCGTTCTCGCTGTTGATTTGTTCGTGAGATTTGAATTCTAGCAATGGCTC
CTCTCGGTGACGGAGCGGCGGCGGCGGCGGCGGAGCCCAACCTGGTG
GTGTCGTTCGGGGAGATGCTGATCGACTTCGTCCCCGACGTCGCCGGCGT
CTCGCTGGCCGAGTCCGGCGGCTTCGTCAAGGCTCCCGGCGGCGCCCCCG
CCAACGTCGCCTGCGCCATCTCCAAGCTCGGTGGCTCCTCCGCCTTCGTC
GGCAAGTTTGGTGATGATGAGTTCGGGCACATGCTGGTGGACATCCTGAA
GAAGAACGGGGTGAACGCGGAGGGGTGCCTGTTCGACGAGCACGCGCGCA
CGGCGCTGGCGTTCGTGACCTTGAAAAGCAACGGCGAGCGCGAGTTCATG
TTCTACCGGAACCCGAGCGCCGACATGCTCCTGACGGAGGCGGAGCTCAA
CCTGGACCTGATCCGGCGCGCCAAGATCTTCCACTACGGCTCCATCTCCC
TCATCACCGAGCCGTGCCGCTCCGCCCACGTCGCCGCCATGCGCGCCGCC
AAGTCGGCCGGCATCCTCTGCTCCTACGACCCC

> SEQ ID NO: 166 contig13  *Arabidopsis thaliana*

AAAGACGCTGAAGAAGAACTTTGCCAACAAGKGKCTTAACGCTAAAGACC
TTGTGGTTCTCTCAGGGGGTCACACCATTGGAATCTCTAGTTGCGCTCTC
GTCAACAGTCGTCTCTACAACTTCACAGGAAAGGGCGATTCTGACCCATC
CATGAACCCTAGCTACGTGAGGGAATTGAAGAGAAAGTGCCCGCCTACAG
ATTTCAGAACCTCACTGAACATGGACCCAGGCAGTGCGTTGACATTCGAC
ACTCACTACTTCAAGGTCGTGGCTCAGAAGAAAGGGCTCTTCACATCTGA
CTCTACGCTTCTCGATGACATTGAGACCAAAAACTACGTTCAGACTCAGG
CCATTCTCCCTCCTGTGTTTTCTTCTTTCAATAAAGATTTCTCCGATTCC
ATGGTCAAACTTGGTTTCGTCCAAATTCTTACCGGCAAAAATGGTGAGAT
CAGGAAGAGATGCGCCTTCCCTAACTAATTTGGATCGATCAGACCGGGTT
TCGGATGATTTTGAGTCTACACGTTTTTCTCTGCTTATTTTCTTTCTTTT
TCTTTTTTCTTTCACGGAAGTTTGAGCTTTG

> SEQ ID NO: 167 contig14  *Arabidopsis thaliana*

GATATGAGTAGCCAAATCGCTTTGTCACCGGSSRTCGCCGCCGCCATTCG
CCGTCCGTCCTCTCACGACTGTCTATCCGCTTCCGCCACTACTGCTACCG
CCACCCCCATGGCTCTCAAATCTTGCATCGTCGCACCTCTCTCGCTATTC
ACCTCTCAATCTCAAATCAAACACTCAAGCTCAAGAAAAACTTCTCGAAC
CACGATTCGATGCGATGTAGCGATAAAATCCGCAGATTCGATAAACGCAG
ACGCCAATCCTTCGTCCTCACCGTCATCAGAGGAAGAAATCGAAGCGGAA

Figure 2e

```
GCGAAGGCGAAGATAGGATCTAGGGTTAGAGTAACTGCACCGTTGAAGGT
TTATCATGTAAATCGAGTTCCAGAGGTTGATTTAGAAGGTATGGAAGGTA
AACTCAAAGATTACGTTGCTGTTTGGAAAGGGAAACGAATCTCAGCTAAT
CTTCCTTATAAGATTGAGTTCTTCAAAGAAATTGAAGGTCGTGGTCTTGT
TAAATTTGTTTCACATCTTAAGGAAGATGAGTTCGAGTTCATTGATCAGT
GATGAAACAAGAAAGACAATTTTTGTTTTCCTTTCTCAGTGTTTGTTTTT
GTTTGTTGTGTTTACTGGAACCTGGGAATGGAGAATGATTTGTATGTAGT
GTGATGTGTATTCAACCTTTAGCAATCATATACATAAGGGTTTCTTCAAA
A
```

> SEQ ID NO: 168 contig15 *Nicotiana bentamiana*

```
CATACATTTTATCAGACAATTCTTCTGGCAGGGAAACCTGATGTCATTTT
GATTGGTACTGGCTCAGAGTTAGAAATTGCTGTCAAGGCTGCTGATGAAC
TCAGGAAAGAAGGAAAGACAGTGMSMGTTGTTTCCTTTGTTTGTTGGGAG
CTTTTCGAAGAACAATCAGCCGACTACAAGGAAAGTGTCCTTCCATCATC
TGTTACAGCTAGAGTTAGCATTGAAGCTGGATCCACATTTGGGTGGGAGA
AATATGTCGGATCAAAGGGGAAGGCCATCGGAATTGATAGATGGGGTGCC
AGTGCCCCTGCTGGAAAAATATACCAGGAGTACGGAATTACAGCAGAGGC
TGTTGTAGCTGCAGCTAAACAAGTTTCTTAGGCTTTATTACTTACACTTG
GTTGCTGGTGTCTACCAAATTTGTTTTCAGTTTGACACTGAGGTTGGAGG
TGATGGTGGAAACCAATACCAAACGGACTCGGCAGTTCACTGTTGCCTGG
TATTTTCAATAAAAACTATTTCTTCATCTGCCCTTTGTTTTCTTCAGTTT
TAGTAGCGGAGCGGCCAAAATGAATCCAAGATGAGGATAGAAATAGGATT
ATGGATGCTCCTGACCATGTACACTTTAAACCATATCTTTGAGTTTTGTA
ATTTCATTTGGTCGAGTGATACCAAGATCTTATTTTCAATTGG
```

> SEQ ID NO: 169 contig16 *Arabidopsis thaliana*

```
GCTAGTGGGAGAATCCGGTTGCATCCCGGAGATCGTGAAACTTCTGGAAT
CGAAGTCMAACGGATGTCGAGAAGCGGCGGCTCAGGCGATCGCTGGATTG
GTAGCGGAAGGAAGGATTCGACGGGAACTGAAGAAAGACGGGAAGAGCGT
TCTGACGAATTTGGTGATGTTATTGGATTCAAACCCTGGAAACACGGCGA
AGAAGTACGCCGTGGCGGGGCTGTTGGGGATGTCGGGAAGCGAGAAGAGT
AAGAAAATGATGGTGTCGTACGGAGCAATAGGGTATCTGAAGAAGCTGTC
GGAGATGGAAGTAATGGGCGCCGATAAGCTTCTCGAGAAGCTTGAAAGAG
GAAAGCTAAKAAGCTTCTTTCACCGGTAAAACGAACGATGCGGAGACATT
GAAGCAGCCAAGATAAAAAGTGTAATATTGTCTGATGTAAGTTTATTAAC
CGTTAGTTAAACTTTACTAGTAATTAAAAAGTGTTCTTTGGGCTGAMMAA
AAAA
```

> SEQ ID NO: 170 contig17 *Nicotiana benthamiana*

```
GCTTCTTCTTCTTCTCACTCTCTCTCAAGCTATCCTCTGTCGTTCAGT
CCCTCGCCATGGCTCTGCCTCTTCTTCTCAACTTTCCCCTTCTTCTCTCA
CTTTTTCCGGCCTTAAATCTAACCCCAATATCACCACCTCCCGCCGCCGT
ACTCCTCCCTCCGCCGCCGCCGTACGGTCATCGACGATTCGTGCATCGGC
TGCAACCGAAACTATACAGAAAACTGAGACTGCCCTTGTTGACAAATCTG
TAAACACTATTCGATTTTTGGCTATTGATGCTGTTGAAAAGGCAAATTCG
GGTCACCCCGGTTTGCCCATGGGTTGTGCTCCGATGGGTCATATACTGTA
CGATGAGGTTATGAGGTATAACCCGAAAAATCCGTATTGGTTTAATCGGG
ATCGGTTTGTTCTATCAGCTGGACATGGTTGTATGCTTCAGTATGCTTTG
CTTCATCTAGCTGGCTATGATGCTGTCAAGGAAGAGGACTTGAAGAGCTT
CCGTCAGTGGGGAAGCAAAACCCCTGGACACCCTGAAAACTTTGAGACAC
CTGGTGKTGAAGTCACCACCGGGCCTCTGGGACAAGGTATTGCCAACGCC
GTTGGCTTGGCCCTTGCAGAGAAACACTTGGCTGCTCGCTTCAATAAGCC
TGACGCTGAGATTGTAGACCACTACACATATGTTATTCTCGGTGATGGTT
GCCAGATGGAGGGTATTTCACAAGAAGCTTGTTCACTTGCTGGACACTGG
```

Figure 2f

```
GGACTTGGAAAGCTGATTGCTTTCTATGATGACAACCACATCTCAATTGA
TGGTGACACAGAAATCGCTTTCACTGAGGATGTTGGTGCCCGTTTTGAGG
CTCTTGGGTGGCACGTAATCTGGGTGAAGAACGGTAACACTGGTTATGAT
GAGATTCGTGCTGCTATTAAGGAAGCAAAAGCTGTCACAGACAAACCCAC
TATGATCAAGGTGACTACAACCATTGGTTTTGGCTCGCCAACAAGGCAA
ACAGTTACAGTGTACATGGAAGTGCACTTGGAGCTAAGGAAGTAGAGGCC
ACCAGGAGTAACTTGGGATGGCCTTATGAGCCGTTCCACGTGCCTGAAGA
TGTCAAGAGCCATTGGAGTCGTCATGTTCCCGAGGGTGCTGCTCTTGAAG
YTGGATGGAATACCAAGTTTGCTGAATATGAAGAAGTACCCMGAGGAA
GCTGCAGAACTCAAATCCATTRYCACTGGTGAACTAMCTGCTGGCTGGGA
GAAAGCTCTGCCTACCTACACACCTGAAAGTCCAGCRGATGCCACCAGAA
ACYTGTCCCAACAAAACCTGAATGCTCTTGCCAAGGTTCTCCCTGGTTTC
CTTGGTGGTAGTGCTGATCTCGCCTCATCAAACATGACTCTCATGAAAAT
GTTTGGTGACTTCCAAAAGAACACCCAGAGGAGCGTAATCTAAGGTTTG
GTGTTCGTGAACATGGTATGGGAGCTATATGTAATGGGATTGCTCTACAC
AGCCCTGGCTTGATTCCCTACTGTGCTACTTTCTTTGTGTTCACTGACTA
CATGAGAGGAGCAATGAGAATTTCAGCCTTGTCTGAGGCTGGAGTTATTT
ATGTTATGACCCACGATTCAATCGGT
```

> SEQ ID NO: 171 contig20 *Nicotiana benthamiana*

```
CTTTTCTTCTTTATTGTATAGATATATACTTTACATTTAYACATRTATTC
TCTCTATTCATMGTCGSTATGGCAGCTAACGGCGTTAGTTCTGGTTTAAT
TGTGAGCTTCGGCGAGATGTTGATCGATTTCGTGCCGACGGTCTCCGGYG
TWTCCCTTGCCGAGGCTCCGGGTTTCTTGAAGGCTCCYGGMGGTGCACCG
GCAAACGTCGCCATCGCAGTGACTAGGCTYGGGGAAAGTCGGCGTTCGT
YGGGAAACTCGGCGACGATGAGTTYGGCCACMTGCTCGCCRGATACTMA
AAMARAACGGCGTYCAAGCSGACGGGATCAACTTYGACAAGGGMGCGAGA
ACGGCRTTGGCATTCGTGACCCTACGCGCCGACGGAGAGCGTGAGTTCAT
GTTCTACAGGAATCCCAGTGCYGATATGTTGCTCACTCCCGRCGAGTTGA
ATCTTGATGTTATTAGATCTGCTAAGGTGTTCCACTACGGTTCGATAAGT
TTGATAGTGGAGCCATGCAGATCAGCACATTTGAAGGCRATGGAAGTGGC
AAAGGAGGCAGGRGCRYTGCTCTCTTATGACCCAAACCTCCGWTTGCCGC
TGTGGCCGTCGGCAGAGGAGGCGAGGAAGCAAATCAAGAGCATCTGGGA
```

Figure 3a

Seq ID NO:172 34406 and 38919 - Ortholog sequence is listed in contig02 and Contig39.
contig02 487 bp
seqids    104672    orthologs (homolog of 34406, 38919)
          109349
          110970

TATCTCCTCAACTTTTCTCTCTTTATTCAAACGCCTCTCAAGATGCAGAT
CTTCGTCAAAACCCTAACTGGAAAGACGATAACCCTTGAGGTTGAAAGCT
CCGACACAATTGACAACGTTAAGGCGAAGATTCAGGACAAGGAAGGAATT
CCACCGGATCAGCAGAGGCTGATCTTCGCCGGAAAGCAGCTCGAAGACGG
CAGAACCCTAGCCGACTACAACATCCAGAAGGAATCGACTCTTCACTTGG
TGCTCCGTCTTCGTGGCGGTATGCAAATCTTCGTCAAAACCCTAACAGGG
AAAACAATCACCCTTGAAGTTGAAAGCTCCGACACTATTGATAACGTTAA
GGCGAAAATCCAGGATAAAGAGGGAATCCCACCAGATCAGCAGAGGTTGA
TCTTTGCTGGCAAACAGTTGGAAGACGGCAGAACCCTAGCCGACTACAAC
ATTCAGAAGGAATCAACTCTTCACTTGGTACTCCGTC

Seq ID NO:173 contig39 585 bp
Seqids    105037    ortholog(homolog of 34406,38919)
          105115
          114478

TTCTGAAGTTCCATTAATATTATCTCAAGAAGAAAAATGGGTTACTTCGT
CTAAAGATAAAATCAAAACCAACAGAGAGTTTAGAACAAAAGTGAATAGA
TAAACTACAGCTCCTGAGAAATGATAATGGCGATTCCTTCCGATACTTCT
TGAAATCTATCCTCCTCATATGTTGCTAGGGTACATGAAGACTCTGACTC
TAGCTCCCATTGACTTGGGTGGTAGGTTTGAAGTGAACTTAGAACGGACA
ACACCGCTGTTACCATGAGGCCTAGTGACTTTGCCCCAAATGCAACGGTA
GTGAGAACCGTTCTTCTTTGTCTTTGCCTTGTAGATGTAAGCCAAACGCT
TACCCTTGTACCAATTGACCTCCTCTTGAGTGTTCACACCTTCAATCTGG
ATGAGAGAAGTGTTGGGATATTGGTTCGACTTGGACCTCTTGTAGCCGAG
GACTGTTCCACGAACATACAATCTAACTCTCTCCTTGACGTCCCTTCA
TTTTCAATCCTTGTAACTCTCGTCTTCCTCTTCTTACTCTCTTTTACGGA
CGCGTGGG

Seq ID NO:174 36415 - Ortholog sequence is listed in contig42
contig42    484 bp
Seqids    108467        ortholog (homolog of 36415)
          111294
CGGACGGTGGGCTGCAATCGTCTGAGGCTTCAGAGKGATTTSTCTCAGTT
ATCCGCTCTCTTCTTGCAGCAGCCATGATTATTTCAGAGAAAAACCGTAG
AGAGATCTCCAAATACCTCTTCCAAGAGGGAGTATGCTATGCCAAGAAGG
ACTACAACTTGGCGAAGCATCCATTGATCGATGTGCCGAACCTCCAGGTG
ATTAAGCTTATGCAGAGCTTCAAATCTAAGGAGTACGTCCGCGAGACGTT
CGCCTGGATGCACTACTATTGGTACCTTACCAATGATGGTATTGAGTTCC
TCAGGACTTACTTGAACCTTCCTTCTGAAATTGTTCCTGCTACTTTGAAA
AAATCTGCTAAGCCTCTTGGTCGTCCAATGGGTGGACCTCCTGGCGATCG
TCCGCGTGGACCACCAAGGTTCGAGGGTGATAGGCCAAGGTTTGGTGATA
GGGAAGGCTATCGTGCTGGACCAAGAGGTCCACC Seq ID NO:175 21627- Ortholog sequence is listed in contig45
contig45  559 bp
Seqids    111309 ortholog (homolog of 21627)
          127560
CCCCCCCCCGAACCACAAACTAGGGTTATTGGCTTGCTGTTTCAGTATCT
ATTGAGCTTCTCTCTACCAATCCCAGCSGAMGCSWKGGGTCGAGGAGAAA
GACTAGGGAGCCAAAGGAAGAGACAGTAACACTTGGACCAGTAACCAGGG
AGGGTGAATTGGTGTTCGGTGTTGCTCACATTTTTGCCTCTTTCAACGAT

Figure 3b

```
ACTTTTATTCATGTGACTGATTTGTCTGGAAGAGAAACTATGGTTCGCAT
TACTGGTGGAATGAAGGTAAAGGCTGATAGAGATGAATCTTCTCCATATG
CTGCCATGCTTGCAGCTCAAGATGTGTCACAGCGATGCAAGGAACTTGGA
ATTAATGCTCTTCACATTAAGCTTCGGGCTACAGGAGGCAACAAGACTAA
GACTCCTGGTCCTGGTGCCCAGTCTGCTCTTAGGGCTTTGGCTCGATCTG
GCATGAAAATTGGACGTATAGAGGATGTGACTCCAATTCCCACAGATAGC
ACTCGCAGAAAGGGTGGTAGAAGGGGAAGGAGGCTGTGAAGATGGTTCGT
TTCTGCAGC
```

Seq ID NO:176 25414 - Ortholog sequence is listed in contig47
contig47    583 bp
Seqids      111725 orthologs (homolog of 25414)
            128377

```
CCAGTTTTGTTAGTTTGAAGTGAAGAGCAGGGCATCTTGGGCAACTCTTG
CTGCAGTACAGCCCACAACTGCCGTCAATGGGCTAGCTGGAAGCTCCATT
ATTGGAACTAAGCTACATGTTAAATCATCTCGCCTTAATTTGAAGTCTAC
TAAATCCAGGGCTGGTTCTGTGGTAGCAAAGTATGGWGACAAGAGTGTAT
ACTTTGATTTAGAGGACYTGGGMAACACCACTGGSCARTGGGACTTGTAT
GGTTCAGATGCACCTTCACCATACAAYYCCCTTCAGAGCAAGTTTTTCGA
GACTTTTGCTGCTCCTTTCACTAAGAGAGGTCTGTTGCTCAAATTCCTGA
TATTGGGAGGTGGCTCAACTCTTGCATACTTCAGTTCAACWGCATCAGSG
GATATAYTACCAATCAAGAAAGGACCTCAACTTCCACCCAAGCTTGGGCC
ACGCGGAAAGATCTAATTTCTTTTCAATCCAACTTTCTCAACCTTCATTT
TGTAATTGATGTATCTGTCACCAGCTTGTAAGTATTCTTGAAGCCTACCT
GAGACCTTTGTTACAGAAGTTAAATCTTATTGC
```

Seq ID NO:177 45846 - Ortholog sequence is listed in contig48
contig48    500 bp
Seqids      107145 orthologs (homolog of 45846)
            128842

```
AACAGAGAAAAATTCTCTCCGATAATGTTGGTTTATCMSGATCTTCTCTC
CGGKGATGAGCTCCTTKCGGATTCATTTCCSTACACTGAACTTGARAATG
GAGTGCTTTGGGAAGTACAAGGGAAGTGGGTTGTTCAGGGAGCTGTTGAT
GTGAACATYGGGGCKAATCCATCTGCTGAAGGYGCASATGAAGAYGAAGG
TGTTGAYGATCAAGCCATCAAGGTTGTYGATATTGWTGACACTTTCAGGC
TTCAGGAGCAACCTTCTTTTGACAAGAAGCAGTTTGTTGCCTACATGAAG
AAATATATCAAGARCCTAACACCCAAGTTAGGCGCAGAGCAGGAAGAAGT
TTTTAAGAACAACATTCAAGGAGCMACCAAGTACCTTTTGTCAAAGCTCA
GTGACCTTCAATTCTTTGTTGGTGAGAGCATGGCTGATGATACTGGAATG
GTGTTTGCCTACTACAAGGATGGCGCCACTGATCCAACCTTTTTGTACCT
```

Seq ID NO:178 25414 - Ortholog sequence is listed in contig49
contig49    567 bp
Seqids      107969 orthologs homolog of 25414)
            111467

```
GAATTCTGAAAATAGTTTTGGTAGTTTGGAGTGAAAAGCCATGGCATCTT
TGGCAACCTTTGCTGCAGTGCAGCCCACTACCAATGTCMMRSGCSTMGCK
GGAAGCTCCATTACTGGAACTAARCTTCATSTCAAATCATCTCGCCTCAA
TTTGAAGMCCACTAAATCCAGGGCYGGCYCTGTGGTYGCCAAATATGGTG
ACAAGAGTGTATACTTTGATTTGGAGGATTTGGGCAACACCACTGGCCAG
TGGGACCTGTATGGATCAGATGCACCTTCACCATACAACTCTCTTCAGAG
CAAGTTCTTTGAGACATTTGCTGCTCCATTCACCAAGAGAGGTCTTTTGC
TCAAATTCTTGATATTGGGAGGTGGCTCCACCCTTGCYTACTTCAGTTCG
ACAGCATCAGGGGATATCCTACCAATCAAGAAAGGTCCACAACTTCCACC
```

Figure 3c

CAAGCTCGGMCCACGTGGCAAGATCTAATTAATTTTTGATCCAATTATCA
ACCTTCTATTTGTAATTGATGTATGTTTCCCAGTTTGTGTAAGTATGTAT
AATTGGAGACTTTCCAT

Seq ID NO:179 25182 - Ortholog sequence is listed in contig50
contig50    678
Seqids       104763  orthologs (homolog of 25182)
             126743
CCCACGCGTCCGCCACGCGTCCGCGGACGCGTGGGGCCGTGGGTTCCAAA
GTTTCCCCAGCCGATGCTGCTTATGGAGAAGCTGCAAATGTTTTTGGTAA
GCCAAAGCAAAACACTGATTTCTTGGCGTACAACGGAGATGGATTCAAGT
TGCAAGTCCCAGCTAAATGGAACCCCAGCAAAGAAGTTGAGTTCCCTGGT
CRMSWTYWCRGMYRKGGAAGACAACTTTGATTCCACCAGCARTCTCATTG
TCACTGTCACTCCAACTGACAAGAAATCCATCACTGGCTATGGCTCCCCT
GAAGAGTTCCTCTCTCAAGTGGACTTTTTGCTAGGAAAGCAAGCTTACTT
TGGTAAAACTGATTCAGAGGGTGGATTTGAATCTGGTGCAGTGGCAACTG
CAAACCTATTGGAGGCATCAAGCACAACTGTGGGAGGAAAAGAGTACTAT
ATCTTGTCAGTATTGACAAGAACTGCAGATGGAGATGAAGGTGGTAAGCA
CCAGTTGATCTCAGCTACAGTAAATGATGGCAAACTTTACATCTGCAAAG
CACAAGCTGGTGACAAGAGATGGTTTAAGGGTGCTAGGAAGTTTGTGGAG
AATGCAGCCACTTCTTTCAGTGTTGCTTAAGAATGGAAATAAAGTAAAAC
CATTAGTATTAAGTTTGTATGTACTTAG

Figure 4a

SEQ ID NO:180 contig03  739 bp
seqids      23869_301102_1 original 154
            23558 new
            23612

CCCACGCGTCCGCTCTTTCCTTCTCTCACCGCGAGAGTAACCGAGAGACA
TGATTCTGATAAACTCTAATTCTCCGACGCTAATCTCAGCCGTTAGATTC
GTGGGCTCATCTCCGTTCACCACTCGGGGGCTTTCTCAGTCCACTGTCTC
AATCTCTAGAAACAAAAGCTTCTTCTTCCACTTCACCGAGACGAAGGAGA
AGAACGCAAGAAGAGATTATTTGAGAGTATCAATCGTGTGTGACGCAGGA
GGGATGTTTCCGGTGGATCCATGGGCTCCAACCATTGATTCACAGAGCAT
AGCATCACAACTCTTCGCTGTATCTCTGTTTCCTTACATTGGCTTTCTCT
ATTTCCTCACTAAATCCAAATCAGCTCCAAAACTCACACTTTTCGGTTTC
TACTTCTTGCTTGCCTTCGTTGGAGCTACAATTCCAGCTGGGATTTATGC
TAAGGTGCATTATGGAACATCGTTGTCGAATGTTGATTGGTTACACGGAG
GAGCTGAATCACTTCTTGCTCTTACCAATTTGTTTATCGTGTTGGGTCTT
AGACAAGCTCTGAGGAAGTCTCAAGATGATGATGATGATAAACTTGGTAA
TGATGATGAAGTTCCAACAACTCAAGAACAAGGGAAATCTTCAGTGTAGT
AAAACAAATGTAAATTTTTTAATTATGGAGTTTCACTTGTTTTTTAATTA
GATTATATATAGTCGACGCCCATCTAATTCCCATTTTAG

SEQ ID NO:181 contig05  1991 bp
Seqids      130065_300484_1 original 154
            130517_300488_1
            130849_300491_1
            131037_300552_1
            131193_300511_1
            131364_300513_1
            167345_300546_1
            167687_300549_1
            167907_300552_1
            182206_300659_1
            182731 new GAATTCAGAAGAAGAACAGAGGAGAAGGAAAAAAGGAATCAATCCTTTAT
TCCGATAATAGCCTCAATCATGGCAGCATCTTCATCCCTTACAGTATCAC
AAGCCCTAGTTGGCAGGAAAATCTCTGGTATTAACACTTCTTCTCGTTCA
CAATCATTACCTGGATTCAGTCTAAGTACTTTRWMWGVAAGAACATTGAA
ATCTTCATTGATTTCATCGATTGCATCATCACGATCTAATCGTGTCAATA
CACCATCGTTATCGAGATCGTTGGTGGTTCGTGCTTCAGCTGTTGAGACT
TTGGAAAAGACAGATACAGCATTAGTTGATAAATCAGTGAATACTATTAG
ATTTCTAGCAATTGATGCTGTCGAGAAAGCTAATTCAGGTCATCCTGGTT
TACCTATGGGATGTGCGCCATGGGTCATATTTTATACGATGAAACCATG
AGATA:TAACCCTAAGAACCCTTACTGGTTTAACAGAGATAGATTCGTTC
TTTCTGCTGGTCACGGTTGTATGTTGCAGTATGCTTTGCTTCATCTTGCT
GGTTACGACAGTGTTACGACAGAAGATTTGAAGACTTTCCGTCAGTGGGG
AAGCAAAATTCCTGGTCACCCCGAGAACTTCGAGACTCCTGGTGTTGAAG
TCACTACAGGTCCCCTTGGACAAGGTATTGCTAATGCTGTTGGATTGGCA
CTTGCCGAGAAGCACTTGGCTGCCCGTTTCAACAAGCCTGACAGCGAGAT
TGTAGACCATTACACATACTGTATTCTTGGAGATGGATGTCAAATGGAGG
GAATTGCAAATGAAGCTTGTTCGCTAGCTGGACATTGGGACTTGGAAAG
CTGATTGCTTTCTACGATGACAACCACATCTCTATTGATGGTGACACAGA
GATTGCTTTCACAGAGAGTGTAGATACCCGTTTTGAAGGTCTAGGATGGC
ACGTAATTTGGGTGAAGAATGGTAACAATGGTTATGATGAAATTCGTGCT
GCCATCAAGGAAGCAAAGTCTGTCACAGACAAGCCCACTTTGATCAAGGT
GACTACCACCATTGGTTTTGGTTCTCCAAACAAGGCAAACTCATACGCCG

Figure 4b

TACACGGTGCTGCATTGGGTTCTAAAGAGGTTGATGCCACAAGGAAGAAC
CTTGACTGGCCATTTGAGCCTTTCCACGTGCCAGAGGAWKTYAAGAGCCA
TTGGAGCCGCCATACTGCTGAAGGTGCTGCCCTAGAAGCTGAATGGACAG
CTAAATTTGCAGAGTACGAAAAGAAGTACTCAGAGGATGCTGCAGAATTT
AAGTCCATCATTACTGGTGAATTCCCTGCTGGTTGGGAGAAGGCTCTTCC
TACCTACACTCCRGAGATCCCAGCTGATGCCACCAGAAACCTATCCCAGA
CATGCCTTAATGCACTTGCTCCAGTCCTCCCTGGTCTTATTGGTGGTAGT
GCAGATCTCGCTTCCTCCAACATGACCTTGATGAAAATGTTCGGAGATTT
CCAAAAGGCCACTCCAGAAGAGAGGAATGTTCGATTTGGTGTCAGAGAGC
ATGCTATGGGAGCCATCTGTAACGGAATTGCTCTCCACAGTCCTGGTTTT
GTCCCCTACTGTGCTACCTTCTTTGTTTTCACCGATTACATGAGAGGTGC
CATGAGAATTTCAGCTTTATCTGAAGCTGGAGTCATTTACGTCATGACCC
ACGACTCTATTGGTCTTGGAGAGGATGGTCCAACTCATCAGCCCATCGAA
CATTTGGCAAGCTTTAGAGCCATGCCTAACATTCTTATGTTCCGTCCCGC
TGACGGAAACGAGACTGCCGGGGCATACAAGGTTGCAGTTGAAAACAGAA
AGAGACCCTCAATTCTTGCCCTTTCACGTCAAAAGCTTGCAAACCTTCCA
GGAACCTCCATTGAAGGAGTCGCCAAGGGAGGTTACACAATATCAGACAA
CTCTACAGGTAACAAACCASATGTCATCGTGTGTGCTACTG

SEQ ID NO:182 contig06   739 bp
seqids          25120_300074_1  original 154
                23814   new
                24080
                30417
CCCACGCGTCCGGAAGAAGAAGAAGTAATGGCTTCCTCTATGCTCTCCTC
TGCCGCTGTGGTTACCTCCCCGGCTCAAGCCACCATGGTCGCTCCATTCA
CTGGTTTGAAGTCATCCGCTTCTTTCCGGTCACCCGCAAGGCCAACAAC
GACATTACTTCCATCACAAGCAATGGGGGAAGAGTTAGCTGCATGAAGGT
GTGGCCACCAATCGGAAAGAAGAAGTTTGAGACTCTATCTTACCTCCCTG
ACCTTACTGACGTCGAATTGGCTAAGGAAGTTGACTACCTTCTCCGCAAC
AAGTGGATTCCTTGTGTTGAATTCGAGTTGGAGCACGGATTTGTGTACCG
TGAGCACGGAAACACTCCCGGATACTACGATGGACGGTACTGGACAATGT
GGAAGCTTCCATTGTTCGGATGCACCGACTCTGCTCAAGTATTGAAGGAA
GTTGAAGAATGCAAGAAGGAGTACCCGGGCGCCTTCATTAGGATCATCGG
ATTCGACAACACCCGTCAAGTCCAGTGCATCAGTTTCATTGCCTACAAGC
CCCCAAGCTTCACTGATGCTTAAATCCTTTTCTGGAATATTCAATGTTGA
CTATCCGGAACCCAATTTTGTATGGTCAATGTAAATTTAAGTAATTATTT
TGCCAAAGTGAAAAAACTGAAGGTTTGTTTTTCTATCATTTCCTCTATAA
AAATCTCTATTCATATCACTTCATTTCTGCTAAAAAAAA SEQ ID NO:183 contig07   617 bp
seqids          25450_300074_1 original 154
                25439 new???
CCCACGCGTCCGCAAACATCAGAAGCCCTAGAGCTTGAGCCGGSGAAAAT
GTCGAAGCGAGGACGTGGAGGAACGTCTGGTAACAAATTCAGGATGTCAC
TTGGTCTGCCCGTTGCAGCCACAGTGAACTGTGCAGACAACACTGGTGCT
AAGAACCTTTACATCATCTCTGTTAAAGGAATCAAAGGTCGTCTCAATCG
GTTACCTTCTGCTTGTGTTGGTGACATGGTTATGGCCACTGTCAAGAAAG
GTAAACCAGACCTCAGGAAAAAGGTTCTTCCTGCTGTGATTGTTAGGCAA
CGTAAGCCATGGCGCCGAAAGGACGGTGTTTTCATGTACTTTGAAGATAA
TGCTGGAGTGATTGTGAACCCTAAGGGAGAAATGAAAGGTTCTGCAATTA
CTGGACCTATTGGGAAAGAGTGTGCGGATCTCTGGCCAAGGATTGCTAGT
GCTGCTAACGCCATTGTCTGAAGATCATTTATCACTTTTGCTGGTTATGT
ATCTGTCTTCAACGAAACGCGAAATAGTTGGTGTTTTGAGTGTTTTAAGT
AGAGACGACAATCTTTTGTGAGCTTCAGACATATTTCCAGTTTCTAAGAG

Figure 4c

ATTTTGCTTAGATTAAA

SEQ ID NO:184 Contig09 750 bp
Seqids      30087_300076_1 original 154
            39346 new
CCCACGCGTCCGCTTCTTCAGGGTTCAGGTGTGAAAGCTGACGCCACCGT
GGCAGCTGACGGTAGCGGTACATTTAAAACTGTGGCTGCTGCGGTTGCCG
CGGCCCCTGAAAATAGTAATAAGAGGTATGTGATACATATAAAAGCCGGA
GTTTACAGAGAGAATGTGGAGGTTGCTAAGAAGAAAAAGAATATAATGTT
TATGGGAGATGGTCGGACGAGAACTATTATCACCGGAAGTCGAAACGTTG
TAGACGGTAGCACCACTTTCCACTCCGCCACCGTTGCTGCTGTCGGCGAG
AGATTCTTAGCTCGTGACATCACTTTCCAAAACACGGCGGGTCCGTCGAA
GCACCAAGCGGTGGCTCTCCGTGTGGGTTCTGATTTCTCCGCCTTCTACA
ATTGCGACATGTTAGCTTATCAAGACACTCTATACGTCCACTCTAACCGT
CAATTCTTCGTCAAATGTCTCATCGCCGGAACCGTTGACTTCATCTTCGG
AAACGCCGCCGTCGTGCTCCAAGACTGTGACATCCACGCTCGCCGCCCTA
ATTCCGGTCAGAAAAACATGGTCACAGCTCAGGGAAGAACGGATCCTAAC
CAGAACACAGGGATCGTTATCCAGAAATGTAGGATCGGTGCCACGTCGGA
TTTACAGTCGGTGAAAGGTAGTTTTCGACGTACTTGGGTCGGCCATGGA
AGGAATATTCACAAACGGTGATAATGCAGTCGGCTATCTCCGACGTGATC SEQ ID NO:185 contig10 744 bp
Seqids      34526_300493_1 original 154
            6507 new
CCCACGCGTCCGGAAGAAGTTCCGTATAACATCTCCATTATTCAGATCAG
TAGAGTTTTACCGTCGGAGACTGCGGCGGCTCCGACTCCTGCTCCGGCGG
AGATGAATCTTACCGGAATAATGTCGGCTCATGGATGCAAAGTGTTTGCT
GAGACTCTTCTCACTAACCCTGGAGCTTCAAAAACCTATCAGGAGAGTTT
AGAAGGAGGCATGACAGTGTTCTGTCCAGGAGATGATGCAATGAAAGGTT
TCTTGCCCAAATACAAGAACTTGACAGCTCCAAAGAAGAAGCATTTCTC
GATTTCCTCGCTGTCCCGACATATTACTCAATGGCGATGCAAATCCAAC
AATGGTCCGATGAACACACTTGCGACAGATGGAGCTAACAAGTTTGAGCT
TACTGTACAGAACGATGGAGAGAAGGTTACCCTCAAGACAAGGATCAACA
CTGTCAAGATCGTTGATACTCTTATTGATGAGCAGCCTTTAGCTATATAT
GCGACTGATAAGGTTTTGTTGCCTAAAGAGTTGTTTAAGGCTTCGGCTGT
TGAAGCTCCGGCTCCTGCTCCGGCACCAGAGGATGGTGATGTTGCGGATT
CTCCAAAAGCGGCTAAAGGGAAAGCGAAAGGAAAGAAGAAGAAGGCTGCA
CCGTCGCCAGATAATGATCCTTTTGGTGACTCGGATTCGCCTGCCGAAGG
GCCTGACGGAGAGGCCGATGATGCGACGGCAGATGATGCTGGTG SEQ ID NO:186 Contig11 717 bp
Seqids      35526_300493_1 original 154
            23732 new
 ATCATCATCATCATCATCGCGTAAAGACCAAAACGCCGATTGCGAATTAC
TTGTTAAAAACGACGCCTTTGGGATTACGGCGAGAGGAGAGCTTTTCAGT
GACGTCATGTCGGTTGGCTCTGTTACTTCTCCGGGAACCGTTGATCTACT
TTTCGCTTGTACTCCACCGTGGCTGTTACGTGGGCTCGCTAGTGGAGCCC
AAGGAGTAATGGGCTTAGGAAGGGCCCAAATCTCACTCCCTTCACAACTC
GCCGCGGAAACTAACGAACGTCGTCGGTTAACTGTTTACCTGTCGCCGTT
GAACGGTGTCGTATCAACGAGTTCGGTGGAGGAGGTTTTTGGAGTGGCTG
CGTCTAGATCGCTGGTTTACACGCCTTTGTTAACCGGTTCGAGTGGCAAC
TACGTAATTAACGTGAAATCGATTAGAGTCAACGGGGAAAAGCTCTCCGT
GGAAGGTCCGTTGGCGGTGGAGCTGAGCACGGTGGTTCCTTACACGATTT
TAGAGAGCTCGATCTACAAGGTGTTCGCGGAAGCTTACGCCAAAGCTGCG

Figure 4d

```
GGTGAAGCTACATCGGTGCCTCCTGTCGCACCGTTTGGGCTCTGCTTCAC
TAGTGACGTAGATTTTCCGCGCGGTAGATCTAGCGTTGCAGAGTGAGATG
GTGCGGTGGAGGATTCATGGGAAGAATCTGATGGTGGATGTTGGTGGTGG
AGTCCGATGCTCGGGGA
```

SEQ ID NO:187 contig13   599 bp
Seqids      45820_300075_1  original 154
            35577     new
```
AATTAGTCTTAATTGATACAAAAACATCATTAAAAAAGCAAGTGCAAAAA
TTCTGAGTAGAGAATGATAATAAAATGGAAAAAACTCAATAACCACCCTT
GAGATCGTTGACAACATCGTAAGGAATGGGAGTGACAGTCTCCAATGTCA
TACCTTCRACCATGAAACCCGGTTTAGGACCTTTAGGCTGTCTCTTGGTG
CTGATAGTCTCWCCTCTGGCTTTAGCATCAGCCTTAAGCACATCGTTCTG
YTTCTTTCTGAGTTTAAACTCCTCAGCACACCTTGACTGTTGCACATGCT
CCACACGCACATGTATCCTCTTCCTTATGATTCTGTTCCCAATCTGTTTG
TTGACTTCAACACCAACGGCACGYTTAGTGACATTCCAGATGCGACCAGT
ACGACCATGGTAGAACTTATGAGGCATACCCTTGTGGATAGCTCCATTAA
CCTTGACATCGACGTAATCGCCGACCTTGAAGGTTCTGAGGTAAGTGGAG
AGTGGAATATAACCCTTCTTCCTGAATGGTCTCGCGAACAGATCTCTTRT
TCTCGCCCTCACTCCGTGTCCCGCCGGCATTTTTCMKCGGACGCGTGGG
```

SEQ ID NO:188 contig14  662 bp
seqids      20023_300163_1  original 154
            111105    new
```
CGGACGCGTGGGTCGCCCACGCGTCCGCCCACGCGTCCGCCCACGCGTCC
GAGAGGATCTCAGAATATGGAGAGAAATGAGTGCACTTGTTGAACGCATG
TGCTGGAAAATAGCAGAAAAAGGAACCAAACAGTGATTTGGGTCAAGCC
TCTAAACAATGACTGTTACATGGAAAGACCAGCTGGTACTCAACCACCAC
TTTGTCGGTCTGATGATGATCCTGATGCTGTTTGGGGTGTGAATATGGAA
GCATGCATAACACCTTATTCTGAACATGACCACAAAGTTAGCGGGAGTGG
ACTGGCTCCTTGGCCAGCTAGGCTAACTTCTCCTCCTCCTCGTCTTRCTG
ATTTTGGGTATWCAACTGAAATGTTTGAGAAGGACATGGAGCTTTGGCAA
CGAAGGGTTGAACATTACTGGAATCTTTTAAGTCCAAAGATCTCYTCAGA
CAGTCTGAKAAAYATCATGGATATGAAGGCCAATTTGGGGTCATTTGCTG
CTGCTTTGAAGGACAAAGATGTTTGGGTCATGAATGTTGTATCCAAAGAT
GGACCTAACACTCTCAAGATTGTATATGACCGTGGTTTGATCGGCACAAC
TCATGACTGGTGTGAAGCATTTTCGACATATCCTAGGACCTATGATTTGG
TCCATGCGTGGA
```

SEQ ID NO:189 contig15   409 bp
Seqids      25043_300074_1 original 154
            25059_300074_1
            25091   new
```
CCCACGCGTCCGATAGACATGTTTCTTCGCGGTCACCACATAGSGAGCAT
TCTCAGCACAAGAACACTCTCTACTCTTCTCATGACAAATCCAGGTCGAA
GCGGTCAAGGTCCAGATCAAGATCCCCCCACAGGCGCCATCGTAAATGAA
CACTCTAGCAAACTGGTCTGAGACTGTACCCGGGACAATATTGTGCGCGG
TGGATCACAGGATTGGGTTAATGTACTGGACGGACATCGATATAATCAAA
AACTATAAAGTCACCGGTTTGTGAGCGAAATAGTGCATAGTAAACCGCTC
TTTCCTTAGTTCTTCAGAAGAAATATCCAAAGATTTTTGACTGACTTGTT
TGACAATATCGTTGGTTGGTTAAGCGTTCCTATGTAAAATTTTGTTCCCT
CTGAAAAAA
```

Figure 4e

SEQ ID NO:190 contig16  799 bp
Seqids     25133_300074_1 original 154
           24013 new
CCCACGCGTCCGGAAGAATCCGAATCCAATTCAATGAGTCTTCTTCGTCT
TCTCCTCGTTGTTGTTGTTCTTCATCTTTCTGCGGTGGCCGGCGACGACG
CCATCGTCTCCAGATTCCAGGAGTACCTCCGAATCAACACGGTTCAGCCC
AACCCGGAATACTACAAAGCCGTTGACTTTATAATATCTCAGGCGAAACC
ACTGTCCCTCGAATCTCAGACGATCGAATTTGTAAAAGGAAAGCCGCTTC
TCCTCCTCAAATGGGTTGGCTCCGACCCAACCCTACCTGCCTTTCTCCTC
AACTCCACACCGATGTCGTTCCCTTCGAGGACTCCAAGTGGACTCACCA
TCCGCTCCAAGCTCACATGGACCACCATGGCGACATCTATGCCAGGGGTT
CCCAGGACATGAAGTGCGTCGGGATGCAGTACCTCGAGGCCATACGCAAG
CTCCAGGCTTCTGGCTTCAAGCCACTCCGATCCGTCTATCTCTCCTTCGT
CCCCGATGAAGAGATTGGCGGCCACGATGGCGCAGAGAAGTTTGCTGAAT
CCCAATTATTCAAGAGCTTGAACATCGCAATCGTGCTCGACGAAGGCCTG
CCATCGCCTACTGAGAGTTACAGAGTATTCTATGGAGAGAGGAGTCCCTG
GTGGCTGGTGATTAAGGCTAAAGGTCCACCTGGCCACGGTGCCAAGCTCT
ATGACAACTCTGCCATGGAGAATCTGCTCAAAAGCATTGAGAGTATTCGC
AGATTCAGAGCTTCTCAGTTCGATCTTCTCAAAGCTGGTGGGATAGCTG SEQ ID NO:191 contig18 467 bp
Seqids     25195_300074_1 original 154
           25712 new
CCCACGCGTCCGGAAGGTGATAAGGAGCATTTGATGTCTGAAATGAACTT
TGAGAAAACATTTGGGCAATCATCCATCTTTGTAACCTCAACTTTGATGG
AAGAAGGTGGTGTTCCTCCGTCATCAAGTCCTGCAGCAACAGCTGCTTTG
ACGGCGGTGATGAGCAATCCCGCGATGGCTTTGGTTGATGAGAGGATGTC
AACAGAAGGAACAGGATTACCCTTTGGTCTAAGCAACAACCTCTTGGGTT
GGATTCTGTTTGGAGTCTTTGGTTTGATCTGGACTTTCTTCTTCGTCTAC
ACTTCATCTCTCGAGGAGGATGAAGAATCTGGTCTTTCACTCTGAAGGAA
GAATCAATCTTTCGTCTTCTCATTTCCATTTTCATGTGAGAACATGAATC
AAAAGTGTTCACCCTTCTAGTTTCTTGTAATTGTTAAGTAAAGACTAAAA
ACTATTTTCAAAAAAAA SEQ ID NO:192 contig20 590 bp
Seqids     27475_300076_1 original 154
           27475_300076_1
           51408 new
CCCACGCGTCCGGATTCGATAAGAAGAATCTACATGGCTCGACATATCAT
GGAGAAGTTCATCGTCGCAGGAGCGGAAATGGAATTGAACTTATCTCATA
AAACCCGACAAGAGATCTTAACCACTCAAGATCTAACTCACACTGATCTC
TTCAAGAACGCATTAAACGAAGTCATGCAATTGATCAAGATGAACTTGGT
AAGAGATTACTGGTCATCCATCTACTTCATCAAGTTCAAAGAAGAAGAAA
GCTGCCACGAGGCAATGCATAAGGAAGGATACAGTTTTTCATCTCCAAGA
CTGAGTTCAGTTCAAGGCTCTGATGATCCTTTCTATCAAGAACATATGTC
AAAGAGTTCCAGATGCAGTAGTCCCGGTTAAGGAGTCTAAAACTGGTACT
AGACCAGAACCCAAACCAATGTTCATAGCAATCCAATCCATGTAATCTTC
CTTCACATTTCTTGTACATGTCATTTTCTCTCTTGTTATACCTAACTGTA
AGAGAAAATGTCCGGTTCGGATTTTGGTTTAGTTTTAAATGTGTATACCG
GACAAAAACTATGGAACCATACTAATTAATATCTCGAAGA

Figure 4f

SEQ ID NO:193 contig21 743 bp
Seqids    25109_300074_1 original 154
          27308 new
CCCACGCGTCCGCAAAGCTGAACTTGGACGATGTGTTCGGGCAGAAGAAT
GAAATTGCCAAATCTGTGGAAGAAGAGCTAGACAAAGCCATGACTGCTTA
TGGTTACGAAATCCTTCAAACCCTAATTATCGACATTGAGCCTGATCAAC
AGGTTAAACGTGCCATGAACGAAATCAACGCCGCGGCGAGGATGAGAGTG
GCAGCGAGCGAAAAAGCAGAGGCTGAGAAAATCATTCAGATCAAAAGAGC
AGAGGGTGAAGCAGAGTCAAAGTACCTGTCGGGACTCGGAATCGCTCGGC
AGAGACAAGCGATCGTGGACGGTCTGAGAGACAGTGTTCTAGGGTTCGCA
GGAAACGTGCCAGGGACGTCAGCGAAGGATGTGTTGGACATGGTGATGAT
GACTCAGTACTTTGACACAATGAGAGATATCGGAGCAACTTCTAAAGCCT
CGGCGGTGTTTATCCCTCACGGTCCAGGCGCCGTCGCTGACGTGGCAACG
CAGATTCGAAATGGATTATTACAGGCCAACAATGCCTCCTAATCACTCAA
GTCAAATTGTCTTGGTCTTCTCTTTATATATTTTTGTATCTTCTTATTAA
AAAGGTAAATTTGACTTTTAATGTAATGGTGTGCTGATTGTGATTTGTCA
TTATGTTTGTACCTATCTCTTTTGTGAGTTGTGTGATAGATATACTTTGT
ATTTGTTCTTAAAAGTCAATATAAATTTCTGTTTGCGAGAGAA SEQ ID NO:194 contig22 691 bp
Seqids    27430_300076_1 original 154
          27434 new
CCCACGCGTCCGGAAACGGTGAATCTGGTTTTGGGTTGGGAACAGGTGGT
TATGCAGCAAGAAACCCAGGGGCTAACAAGGCAGCACCATCCTCTTCATT
CTCTTCTGCCTCAGCAACCAACAACACGGGTTATGATACAGCAGGACTTG
CAGAGTTTTACGGGAATGGTGCAGTTTATAGTGACCCTACATGGAGATCA
CCAACTCCTGAGACAGAAGGGCCTGCTCCTTTTAGCTATGGGATTGGAGG
AGGGGTTCCTTCTTCAGATGTTTCAGCTAGAAGTTCATCTCCAGGTTATG
TTGGCAGTTACAGTGTGAACAAGAGACAACCAAACAGAGGAATTGCTACT
TAGTACAATCGTTTTTGTTTTACCACGATATTGTAGGCGAGCCATCACGG
TGAACGATCTGTGTCTTTTGGCGAATCTTTTAGATTATCTTCTTTTCCCT
TCATACAAAGCCAGTGAGGACGAAACTTGATCATATCATCACCTAGAGCT
AACCAGAGAATCCCGCAGACTTTTCTGTCATGGTTTGGTTTTCTAAATTC
ATTGTTCCTCCTAGGCTTTTTTTCTGCTTTCTTTTTTTTCTATTTTTGT
TTTCTTTTCTTCTTTCAATGAGGGACAGAAGAAACTGTATCAGTCTCCGG
CGAGGCGGTAATACATAAGGAGAGTTCAAAACAAAAACCCA SEQ ID NO:195 contig23 636 bp
Seqids    137105_300502 original 154
          175736_300544_1
          183116_300619_1
          183532_300623_1
          190868 new
CCCCCCCCGATCGCTTCTCATCGCAAATCGCATCGACTTCGATTCGCTTC
GTTTCGTTCTCGCTGTTGATTTGTTCGTGAGATTTGAATTCTAGCAATGG
CTCCTCTCGGTGACGGAGCGGCGGCGGCGGCGGCGGAGCCCAACCTG
GTGGTGTCGTTCGGGGAGATGCTGATCGACTTCGTCCCCGACGTCGCCGG
CGTCTCGCTGGCCGAGTCCGGCGGCTTCGTCAAGGCTCCCGGCGGCGCCC
CCGCCAACGTCGCCTGCGCCATCTCCAAGCTCGGTGGCTCCTCCGCCTTC
GTCGGCAAGTTTGGTGATGATGAGTTCGGGCACATGCTGGTGGACATCCT
GAAGAAGAACGGGGTGAACGCGGAGGGTGCCTGTTCGACGAGCACGCGC
GCACGGCGCTGGCGTTCGTGACCTTGAAAAGCAACGGCGAGCGCGAGTTC
ATGTTCTACCGGAACCCGAGCGCCGACATGCTCCTGACGGAGGCGGAGCT
CAACCTGGACCTGATCCGGCGCGCCAAGATCTTCCACTACGGCTCCATCT

Figure 4g

CCCTCATCACCGAGCCGTGCCGCTCCGCCCACGTCGCCGCCATGCGCGCC
GCCAAGTCGGCCGGCATCCTCTGCTCCTACGACCCC

SEQ ID NO:196 contig24 341 bp
Seqids      27459_300076_1 original 154
            27464 new
            27494
CCCACGCGTCCGACGATGTTGATCACAAGGGGCAAGAGATGGTAACAACA
GTTTGCATGAAATGCCACATGCTGGTTATGTTGTGTACATCAACTCCTGT
TTGTCCCAACTGCAAGTTCATGCACCCACACGATCACAGCTCTACAAAAC
TGTTTAAACCATCAAATTTGCTTAGGCTTCTATGCTAGGCTCTTTCAAGG
TTACTGAATCTATAAAATTTGTACGGCAGATAATAAGCCAAGAGACTAGA
TATGGACAAAGTTATGTATATACTAAAAGTACCAGAAAGTTTGTATTAAT
TCTCTGCTTCTATGAACGATCATGCTTTAGATCTCTAAAAA SEQ ID NO:197 contig25 581 bp
Seqids      25610_300074_1 original 154
            25180_300074_1
AAAGACGCTGAAGAAGAACTTTGCCAACAAGKGKCTTAACGCTAAAGACC
TTGTGGTTCTCTCAGGGGGTCACACCATTGGAATCTCTAGTTGCGCTCTC
GTCAACAGTCGTCTCTACAACTTCACAGGAAAGGGCGATTCTGACCCATC
CATGAACCCTAGCTACGTGAGGGAATTGAAGAGAAAGTGCCCGCCTACAG
ATTTCAGAACCTCACTGAACATGGACCCAGGCAGTGCGTTGACATTCGAC
ACTCACTACTTCAAGGTCGTGGCTCAGAAGAAAGGGCTCTTCACATCTGA
CTCTACGCTTCTCGATGACATTGAGACCAAAAACTACGTTCAGACTCAGG
CCATTCTCCCTCCTGTGTTTTCTTCTTTCAATAAAGATTTCTCCGATTCC
ATGGTCAAACTTGGTTTCGTCCAAATTCTTACCGGCAAAAATGGTGAGAT
CAGGAAGAGATGCGCCTTCCCTAACTAATTTGGATCGATCAGACCGGGTT
TCGGATGATTTTGAGTCTACACGTTTTTCTCTGCTTATTTTCTTTCTTTT
TCTTTTTTCTTTCACGGAAGTTTGAGCTTTG SEQ ID NO:198 contig26 713 bp
Seqids      25158_300074_1 original 154
            25196_300074_1
            22143 new
CCCACGCGTCCGGATATGAGTAGCCAAATCGCTTTGTCACCGGCCATCGC
CGCCGCCATTCGCCGTCCGTCCTCTCACGACTGTCTATCCGCTTCCGCCA
CTACTGCTACCGCCACCCCATGGCTCTCAAATCTTGCATCGTCGCACCT
CTCTCGCTATTCACCTCTCAATCTCAAATCAAACACTCAAGCTCAAGAAA
AACTTCTCGAACCACGATTCGATGCGATGTAGCGATAAAATCCGCAGATT
CGATAAACGCAGACGCCAATCCTTCGTCCTCACCGTCATCAGAGGAAGAA
ATCGAAGCGGAAGCGAAGGCGAAGATAGGATCTAGGGTTAGAGTAACTGC
ACCGTTGAAGGTTTATCATGTAAATCGAGTTCCAGAGGTTGATTTAGAAG
GTATGGAAGGTAAACTCAAAGATTACGTTGCTGTTTGGAAAGGGAAACGA
ATCTCAGCTAATCTTCCTTATAAGATTGAGTTCTTCAAAGAAATTGAAGG
TCGTGGTCTTGTTAAATTTGTTTCACATCTTAAGGAAGATGAGTTCGAGT
TCATTGATCAGTGATGAAACAAGAAAGACAATTTTTGTTTTCCTTTCTCA
GTGTTTGTTTTTGTTTGTTGTGTTTACTGGAACCTGGGAATGGAGAATGA
TTTGTATGTAGTGTGATGTGTATTCAACCTTTAGCAATCATATACATAAG
GGTTTCTTCAAAA

Figure 4h

SEQ ID NO:199 contig27 675 bp
Seqids      45689_300075_1 original 154
            27502 new
TACAAAGTTTACACTGTTGATGCATACGGATCTTTCCYYATCGAYRWCYK
CTCTACATTTATCAAGCAAGTGTATGCGGKTGGAGCAAGGAAGATCGGTG
TGACATCTCTGCCTCCAACAGGATGTCTTCCCGCTGCAAGAACCCTTTTC
GGTTTCCATGAAAAAGGCTGTGTTTCAAGACTCAACACAGATGCTCAAAA
CTTTAACAAGAAGCTTAACGCTGCTGCTTCAAAGCTTCAGAAGCAATATT
CCGATCTTAAGATTGTTGTCTTCGACATCTACTCTCCACTTTATGATCTT
GTTCAGAACCCTTCCAAATCCGGATTCACGGAAGCAACCAAAGGATGTTG
TGGAACAGGAACAGTCGAGACAACTTCACTCTTGTGCAACCCGAAATCGT
TTGGGACATGCTCCAATGCTACTCAGTATGTGTTCTGGGACAGTGTGCAT
CCTTCTGAAGCTGCCAATGAGATTCTTGCCACTGCCCTAATTGGACAGGG
CTTTTCTCTCCTCGGTTGATCTCACGTATTTTCTTATATTCTCTTTTCA
AATCGCTGTTTCTATCACACATTGAGTCATACATTTGTTTTTCTTTGAAT
TATGTATCAAAGCATCACTGTTTTACTAAAAATGTATTGAAACTTATTAC
AAGTACTAAMCCAAGAGTTGAGAAC SEQ ID NO:200 contig28  693 bp
Seqids      120136_300076_1 original 154
            127617_300359
CATACATTTTATCAGACAATTCTTCTGGCAGGGAAACCTGATGTCATTTT
GATTGGTACTGGCTCAGAGTTAGAAATTGCTGTCAAGGCTGCTGATGAAC
TCAGGAAAGAAGGAAAGACAGTGAGAGTTGTTTCCTTTGTTTGTTGGGAG
CTTTTCGAAGAACAATCAGCCGACTACAAGGAAAGTGTCCTTCCATCATC
TGTTACAGCTAGAGTTAGCATTGAAGCTGGATCCACATTTGGGTGGGAGA
AATATGTCGGATCAAAGGGGAAGGCCATCGGAATTGATAGATGGGGTGCC
AGTGCCCCTGCTGGAAAAATATACCAGGAGTACGGAATTACAGCAGAGGC
TGTTGTAGCTGCAGCTAAACAAGTTTCTTAGGCTTTATTACTTACACTTG
GTTGCTGGTGTCTACCAAATTTGTTTTCAGTTTGACACTGAGGTTGGAGG
TGATGGTGGAAACCAATACCAAACGGACTCGGCAGTTCACTGTTGCCTGG
TATTTTCAATAAAAACTATTTCTTCATCTGCCCTTTGTTTTCTTCAGTTT
TAGTAGCGGAGCGGCCAAAATGAATCCAAGATGAGGATAGAAATAGGATT
ATGGATGCTCCTGACCATGTACACTTTAAACCATATCTTTGAGTTTTGTA
ATTTCATTTGGTCGAGTGATACCAAGATCTTATTTTCAATTGG SEQ ID NO:201 contig29  516 bp
Seqids      27414_300076_1 original 154
            27415_300076_1
            2784 new???
CCCACGCGTCCGGCTAGTGGGAGAATCCGGTTGCATCCCGGAGATCGTGA
AACTTCTGGAATCGAAGTCAAACGGATGTCGAGAAGCGGCGGCTCAGGCG
ATCGCTGGATTGGTAGCGGAAGGAAGGATTCGACGGGAACTGAAGAAAGA
CGGGAAGAGCGTTCTGACGAATTTGGTGATGTTATTGGATTCAAACCCTG
GAAACACGGCGAAGAAGTACGCCGTGGCGGGGCTGTTGGGGATGTCGGGA
AGCGAGAAGAGTAAGAAAATGATGGTGTCGTACGGAGCAATAGGGTATCT
GAAGAAGCTGTCGGAGATGGAAGTAATGGGCGCCGATAAGCTTCTCGAGA
AGCTTGAAAGAGGAAAGCTAAGAAGCTTCTTTCACCGGTAAAACGAACGA
TGCGGAGACATTGAAGCAGCCAAGATAAAAAGTGTAATATTGTCTGATGT
AAGTTTATTAACCGTTAGTTAAACTTTACTAGTAATTAAAAAGTGTTCTT
TGGGCTGAAAAAAAAA

Figure 4i

SEQ ID NO:202 contig30 727 bp
Seqids    25405_300074_1 original 154
          30778 new
          36476
          39315
          53473

CCCACGCGTCCGCAAAAGAAGAAGAGAAACAACAAGAAGTAGTAATGGC
TTCCTCTATGCTCTCCTCCGCCGCTGTGGTTACATCCCCGGCTCAGGCCA
CCATGGTCGCTCCATTCACCGGCTTGAAGTCATCCGCTGCATTCCCGGTC
ACCCGCAAGACCAACAAGGACATCACTTCCATCGCAAGCAACGGGGGAAG
AGTTAGCTGCATGAAGGTGTGGCCACCAATTGGAAAGAAGAAGTTTGAGA
CTCTATCTTACCTCCCTGACCTTAGTGACGTCGAATTGGCTAAGGAAGTT
GACTACCTTCTCCGCAACAAGTGGATTCCTTGTGTTGAATTCGAGTTAGA
GCACGGATTTGTGTACCGTGAGCACGGAAACACTCCCGGATACTACGATG
GACGGTACTGGACAATGTGGAAGCTTCCATTGTTCGGATGCACCGACTCC
GCTCAAGTGTTGAAGGAAGTTGAAGAATGCAAGAAGGAGTACCCGGGCGC
CTTCATTAGGATCATCGGATTCGACAACACCCGTCAAGTCCAATGCATCA
GTTTCATTGCCTACAAGCCCCCAAGCTTCACCGAAGCTTAATTTCTTTTC
TAAAACATTCTTATGAATTATCTCTGCTCATTTCATTTCCTATTGTCTGT
GTTCTTTTTCTCTTTATGAGACAATTTCTATCGGATTGTCAAATGTCTGA
TTTATGAATATGTAATTTATATAAAAA

SEQ ID NO:203 contig31 1626 bp
Seqids    105039_300046_1 original 154
          112163_300040_1
          115126_300012_1
          29267_300160_1

GCTTCTTCTTCTTCTCTCACTCTCTCTCAAGCTATCCTCTGTCGTTCAGT
CCCTCGCCATGGCTCTGCCTCTTCTTCTCAACTTTCCCCTTCTTCTCTCA
CTTTTTCCGGCCTTAAATCTAACCCCAATATCACCACCTCCCGCCGCCGT
ACTCCTCCCTCCGCCGCCGCCGTACGGTCATCGACGATTCGTGCATCGGC
TGCAACCGAAACTATACAGAAAACTGAGACTGCCCTTGTTGACAAATCTG
TAAACACTATTCGATTTTTGGCTATTGATGCTGTTGAAAAGGCAAATTCG
GGTCACCCCGGTTTGCCCATGGGTTGTGCTCCGATGGGTCATATACTGTA
CGATGAGGTTATGAGGTATAACCCGAAAAATCCGTATTGGTTTAATCGGG
ATCGGTTTGTTCTATCAGCTGGACATGGTTGTATGCTTCAGTATGCTTTG
CTTCATCTAGCTGGCTATGATGCTGTCAAGGAAGAGGACTTGAAGAGCTT
CCGTCAGTGGGGAAGCAAAACCCCTGGACACCCTGAAAACTTTGAGACAC
CTGGTGKTGAAGTCACCACCGGGCCTCTGGGACAAGGTATTGCCAACGCC
GTTGGCTTGGCCCTTGCAGAGAAACACTTGGCTGCTCGCTTCAATAAGCC
TGACGCTGAGATTGTAGACCACTACACATATGTTATTCTCGGTGATGGTT
GCCAGATGGAGGGTATTTCACAAGAAGCTTGTTCACTTGCTGGACACTGG
GGACTTGGAAAGCTGATTGCTTTCTATGATGACAACCACATCTCAATTGA
TGGTGACACAGAAATCGCTTTCACTGAGGATGTTGGTGCCCGTTTTGAGG
CTCTTGGGTGGCACGTAATCTGGGTGAAGAACGGTAACACTGGTTATGAT
GAGATTCGTGCTGCTATTAAGGAAGCAAAAGCTGTCACAGACAAACCCAC
TATGATCAAGGTGACTACAACCATTGGTTTTGGCTCGCCCAACAAGGCAA
ACAGTTACAGTGTACATGGAAGTGCACTTGGAGCTAAGGAAGTAGAGGCC
ACCAGGAGTAACTTGGGATGGCCTTATGAGCCGTTCCACGTGCCTGAAGA
TGTCAAGAGCCATTGGAGTCGTCATGTTCCCGAGGGTGCTGCTCTTGAAG
YTGGATGGAATACCAAGTTTGCTGAATATGAGAAGAAGTACCCMGAGGAA
GCTGCAGAACTCAAATCCATTRYCACTGGTGAACTAMCTGCTGGCTGGGA
GAAAGCTCTGCCTACCTACACACCTGAAAGTCCAGCRGATGCCACCAGAA
ACYTGTCCCAACAAAACCTGAATGCTCTTGCCAAGGTTCTCCCTGGTTTC

Figure 4j

CTTGGTGGTAGTGCTGATCTCGCCTCATCAAACATGACTCTCATGAAAAT
GTTTGGTGACTTCCAAAAGAACACCCCAGAGGAGCGTAATCTAAGGTTTG
GTGTTCGTGAACATGGTATGGGAGCTATATGTAATGGGATTGCTCTACAC
AGCCCTGGCTTGATTCCCTACTGTGCTACTTTCTTTGTGTTCACTGACTA
CATGAGAGGAGCAATGAGAATTTCAGCCTTGTCTGAGGCTGGAGTTATTT
ATGTTATGACCCACGATTCAATCGGT

SEQ ID NO:204 contig32 597 bp
Seqids       34415_300077_1 original 154
             34477 new
             52072
CCCACGCGTCCGGAGAGAAGAATAGTTTGATCATCTTGGGAGAAAAATAA
TGGCTGCTTCAGTGATGCTATCTTCGGTGACATTGAAACCAGCTGGTTTC
ACGGTGGAGAAGACGGCGGCTAGAGGATTACCGTCGCTCACAAGAGCTCG
TCCCTCCTTCAAAATTGTCGCCAGTGGCGTCAAGAAGATCAAGACCGACA
AGCCCTTCGGAATTAACGGCAGCATGGACTTGAGGGACGGCGTCGACGCC
TCCGGCAGAAAGGGCAAGGGATACGGTGTTTACAAGTACGTCGACAAGTA
TGGAGCTAACGTCGATGGATACAGTCCTATTTACAACGAGAACGAGTGGT
CAGCGAGTGGTGACGTGTACAAGGGAGGAGTCACCGGATTGGCAATTTGG
GCGGTAACTCTCGCCGGAATTCTTGCCGGAGGTGCTCTTCTTGTGTACAA
CACAAGTGCTTTGGCTCAGTAAATCTTAAAGTTGTTAGCGCATGTGTAAT
CATGTTTCTATAAATGTTTCTGTGTTGTTCTCTTTCTCTAATGTTGTA
AAACTCAGACATACTTTGAATTTATAAGACTTCTAGTGTTTGTATAA SEQ ID NO:205 contig33 649 bp
Seqids       107582_300379_1 original 154
             109167_300043
CTTTTCTTCTTTATTGTATAGATATATACTTTACATTTAYACATRTATTC
TCTCTATTCATMGTCGSTATGGCAGCTAACGGCGTTAGTTCTGGTTTAAT
TGTGAGCTTCGGCGAGATGTTGATCGATTTCGTGCCGACGGTCTCCGGYG
TWTCCCTTGCCGAGGCTCCGGGTTTCTTGAAGGCTCCYGGMGGTGCACCG
GCAAACGTCGCCATCGCAGTGACTAGGCTYGGGGGAAAGTCGGCGTTCGT
YGGGAAACTCGGCGACGATGAGTTYGGCCACMTGCTCGCCGRGATACTMA
AAMARAACGGCGTYCAAGCSGACGGGATCAACTTYGACAAGGGMGCGAGA
ACGGCRTTGGCATTCGTGACCCTACGCGCCGACGGAGAGCGTGAGTTCAT
GTTCTACAGGAATCCCAGTGCYGATATGTTGCTCACTCCCGRCGAGTTGA
ATCTTGATGTTATTAGATCTGCTAAGGTGTTCCACTACGGTTCGATAAGT
TTGATAGTGGAGCCATGCAGATCAGCACATTTGAAGGCRATGGAAGTGGC
AAAGGAGGCAGGRGCRYTGCTCTCTTATGACCCAAACCTCCGWTTGCCGC
TGTGGCCGTCGGCAGAGGAGGCGAGGAAGCAAATCAAGAGCATCTGGGA SEQ ID NO:206 contig34 478 bp
Seqids       45801_300075_1 original 154
             4837 new
TCGCGCGTCTTGGTTGTAAACACCGACCCTTCTATCGTGTAGTTGTCGCC
GATGAAAAATCGCGCAGGGACGGTAAACAAATCGAGGTGTTAGGCTTTTA
TGATCCACTCCAAGGCAAAGAAGATGCGGATAGAGTGAGCCTCAAATTCG
ACAGAATCAAGTACTGGTTATCTGTTGGAGCTCAACCAACAGACACAGTG
GAAAGCATGCTTTTCAGGGCCGGTTTGATACCACCAAAGCCTATGGTAGT
GGTCGGTTCGAAAAATGGGCAGAAGTCTACGAGCCAACATGTTTCACCCA
TTACAGGTGAAATCTTGAACTAAGAGTGTTGATGCGTTGAGCAAGAAAGA
GCCTTTTGTGTCTGTGTGAAAGGAGTTTATGTAATGTTGTTTAAGACTTT
TCTGTTTATGTGAAAGGAGTTAATGTAATGTTGTTTAAGACTTTTGCTTT
CTATGTGAAAGCAGTTTAATGTTATGTT

Figure 4k

SEQ ID NO:207 contig35 611 bp
Seqids      27740_300076_1 original 154
            51409 new
CCCACGCGTCCGCTCGGTGAGGCTGTCGGTGTTGAAGGGCTGGTTGTCGG
TCTGCGCGCTCAGCGCCAGCAGCGCGCGCCGCGAGAAGCAGGTACCGACA
CCGGCCGACGGCACCATGCCGGAAACACTTTCGCGCACCACCAGATCCTT
GGCATGCCATTCGGCGAACTCGTCCATGTAGACGCCGGCCACCAGTTCGT
ACCACTCGCGGTCCAGCGAGGTGACCGGCAACTGGATCATGTCCTTGCGC
GGCAAAAGGTAGTTGTAGAAGCGCAGTTCCATCGGGTGCAGCACGTCCTC
GCTGTCGTGCAGGATCACCCCGGCGAACTCGATGTCGTGGCGCTTCTCGT
AATCGAAGATGGCCAGGATCAGCCAGTTCAGGCAGTCGGCCTTGCTGGTC
GGCCCGTCATGCGGCACTTCCACGCGGCGCAGGCGCTTGTAGCGGCGGCG
CATGCGCTCCACTTCGTCGATGGTCTGCTGGTCGTTGGGATAGGTGCCGA
CGAACACGACGTACTCGCGGTAATCGAGTACGTTGATCATGTTCTCCACC
ATCTGCGCGATGACGTCGTACTCCATCCACGCCGGCACCATGATCGCCAG
CGGCTGTTGCG SEQ ID NO:208 contig36 550 bp
Seqids      27460_300076_1 original 154
            51412 new
GCAGCAGCAAGAGCCTCAATACGTCCATGGTAAGGGTAACCACCACGGTC
AAAGGCTACCTTTGTGATACCTTTCTCCAAGCAAGATTTTGCTATCACTT
CCCCAACTTTCTTCGCTACCTCAATGGTTGGTCCAGAGGTGTAGTCGAAC
TCTTCAGAGATTGGTTTCTGCTTAGTGGAAGCTGAAGCTAAGGTGTGCAT
CTTGGTATCATCAATCACTTGAACATAAAGATGCTTGTTTGATCGGAAAA
CACATAGCCTTGGCCTCTCCGTTGTACCATTAACCTTCTTACGGATACGA
GAGTGGCGGGCGATTCTGTCTTCGCTGCTGGTTTTGGTTTTGGCTTCGAC
AACCATGGACCGAGACTGAAGCGAAGAAGACGACCATGGTTTAAGGAAAA
CGGCACGGTGTTGAAGTCCGTTTCCCAAGAACGCACTGCGGTTAGTTATC
AGACTCACTGAACCACACCCACTCACGCTCGTCAYTCTCTCTTACTCACT
CTCTCTGGCTCGCTCTCTGTTCGTAAAAGCCTAGTTCTAGATCGCGAGCG SEQ ID NO:209 contig37 934 bp
Seqids      23242_301102_1 original 154
            52317 new
CTCAATGGAGTACAAACATTTCAGCCATCCACACACTCTAAAACTCCAAC
AGATTCAGCCACATAAAAGCTCAGATTCTTCAGTAATCTGCTCAGGTTGT
GAATCAGCCATCTCTGAATCCGAAACCGCGTATATCTGTTCAACATGTGA
CTTCAATCTTCATGAGCAATGTGGTAACGCAGTGCGTGGGATGCAACATC
CTTCTCACGCTGGTCTCCACCACTTGACTCTAGTCCCTTACACAACTTAC
AGCGCTGGTACCTTCCTCTGCAGAGCCTGTGGCTGCACTGGAGGTAAAGG
GTTCTCTTACTGTTGTCCKTTGTGTGACTTTGACCTTCATGTTCAATGCG
CTCACCTGCCTCAGGTCTTGGTTCATGAGTCTCATCCTATGCATAGTCTT
CTTCTTGTCTACAACAGTACTCCTCCTATGTCTTTTACTCAGTTTGGTTT
CGGGAATCAGCTTGTTTGCAATCTTTGTAATATGACTATGGATGGTAGGT
TTTGGTCTTACAACTGTTATGCTTGTAACTATCATATTCATGCTTCATGT
GCTGTGAATAAGCCCAATCCAGTGGCTGCTTCTGCTGAGAACTGTGGGGC
GAGTGATGAAGGAAAGACACCGACTGCTGAATCTGTTCCTGTTCAGGGTT
TGGAGACTGAGCAGACGGAACAAGTAGCTGCAATAACAGAGCAAGTGGAA
GATCCAGTTTTGAGGCAACAGCTTGAGCTTCAGAAGCTTCAGCTTGAGCT
AGATATGAGTTCTGCTCTCGCAAACATGATTGGTTCCTTCAATCTCAGTT
CTTTCGTTTGAAGTGTCTTTGTGTTTCAGTTTGTTTGATTTTATGCATTT
ACATGTGTTGAATTGTCTCTGTTCTTGTGTTCCCTAATGTCCCTCTGATT
TGAATAAATATATCCTATCTATTTGGTTTAAAAA

Figure 41

SEQ ID NO:210 contig38 433 bp
Seqids     25466_300074_1 original 154
           52725 new
GCAGCTATAGAGAATCTTCAAGCATTAGAAGGATTTGTGAATCAAGCAGA
TCATCTGAGGCAACAAACTTTGCAACAAATGGCGAAGATCTTAACGACAA
GACAATCGGCTCGAGGTTTACTAGCTTTAGGAGAGTATCTTCATAGACTT
CGTGCTCTTAGTTCTCTTTGGGCAGCTCGTCCACAAGAACCAACTTAAAA
GAGGAACTTATTAAAACTTTAAAAACAAGAAACAGCAGAATCAAAAGTCT
TGAAGAAGCATACTCATCACAAAGCTTGGAAGGATGTTTTAAAAAAGATC
TTTGTTAATTAAGTAGAGTGAGATTCTCTTGATTAGAACTTTATGGTTTT
TGCTTTATGAAGTATCTCTCCAGAGAAGATTGTAAATTTGGGTTGAAACT
TTGTAATATATTTAGATACAACAAATAAGTTTG SEQ ID NO:211 contig40 616 bp
Seqids     25164_300074_1 original 154
           25111 new
CCCACGCGTCCGTGTAACCATGCCTTCTCTCTACGAAAAATCGGAACTTT
TCTCTGTCACAGAGAATTTTCTAAATCCGAGATTCACCTGGACCATTCGG
GGATTCTCTACGCTGCTAAAAAACAGTTACCTATCAGAAGTGTTCTCCAT
CGGAGGAAGAAGTTGGAATATACAAATCAATCCAAGTGGTCTTGGTACGG
GAGAGGGAAAAGCTTTGTCGATGTATCTTGGCCTTAATGTGAATGAGATA
TTCAGACCATATGAGAAGATTTATGTTCGAGCCAAGCTTCGAGCTCTTAA
CCAACTCAATCTCAGTAACATCGAAAGGGAACTCGATATTTGGTACAATG
GTCCGGGATATGGAGAATATAGCTGGGGTTTCCCTGAGTTTATCTATTTC
CCTTATCTCACAGATTCATCAAAGGGTTTCGTTAAGAACGATGTGTTGAT
GGTTCAAGTTGAAATGGAGGCCATTTYTTCAACCAAGTACTTCCCGAGTT
AGATTTTCTYTAAGCAAAGAACTTGTACCTACCTCCATGTGTTTGATTTG
TTATCAAATACTAATAAGAATTTGATTATGCMTTTCAAATACAATTGTTT
CTTTTTCTTAAAAAAA SEQ ID NO:212 contig41 630 bp
Seqids     25101_300074_1 original 154
           25149 new
           25189
CCCACGCGTCCGCTTTCATGTGAGAGAGAGAGTTGAATTTTGCAGATGAG
TATGAGAAGAAGCAAAGCGGAAGGGAAGAGGAGCTTACGAGAACTGAGTG
AGGAAGAGGAAGAAGAAGAAGAAACTGAAGATGAAGATACTTTTGAAGAA
GAAGAGGCTTTGGAGAAGAAGCAGAAAGGTAAAGCTACAAGTAGTAGTGG
AGTTTGTCAGGTCGAGAGTTGTACCGCGGATATGAGCAAAGCCAAACAGT
ACCACAAACGACACAAAGTCTGCCAGTTTCATGCCAAAGCTCCTCATGTT
CGGATCTCTGGTCTTCACCAACGTTTCTGCCAACAATGCAGCAGGTTTCA
CGCGCTCAGTGAGTTTGATGAAGCCAAGCGGAGTTGCAGGAGACGCTTAG
CTGGACACAACGAGAGAAGGCGGAAAAGCACAACTGACTAAAGACGGTGA
AACGTGTGAGATCCCGGTTTGAAGGTTAATGAAACAGGCTTTGCTTACTC
TCTTCTGTCAGTCTCTTTTAGCTCCTTGTAATCCTCTGTGTCTCTGTCTG
TTTCTCCATATTACCTGTAATCAAAGCTATCTGCTAAACCTACGACATGG
TTAAATAAATGCATTGAGACTTAGTAAAAA

Figure 4m

SEQ ID NO:213 contig43 672 bp
Seqids       30913_300077_1 original 154
             190855 new
             190880
GCTGATTTAACAAATTTTAACAAAATATTAACGCTTACAATTTC:C:TGA
TGCGGTATTTTCTCCTTACGCATCTGTGCGGTATTTCACACCGCATCAGG
TGGCACTTTTCGGGGAAATGTGCGCGGAACCCCTATTTGTTTATTTTTCT
AAATACATTCAAATATGTATCCGCTCATGAGACAATAACCCTGATAAATG
CTTCAATAATAGCACGTGAGGAGGGCCACCATGGCCAAGTTGACCAGTGC
CGTTCCGGTGCTCACCGCGCGCGACGTCGCCGGAGCGGTCGAGTTCTGGA
CCGACCGGCTCGGGTTCTCCCGGGACTTCGTGGAGGACGACTTCGCCGGT
GTGGTCCGGGACGACGTGACCCTGTTCATCAGCGCGGTCCAGGACCAGGT
GGTGCCGGACAACACCCTGGCCTGGGTGTGGGTGCGCGGCCTGGACGAGC
TGTACGCCGAGTGGTCGGAGGTCGTGTCCACGAACTTCCGGGACGCCTCC
GGGCCGGCCATGACCGAGATCGGCGAGCAGCCGTGGGGCGGGAGTTCGC
CCTGCGCGACCCGGCCGG:CAACTGCGTGCACTTCGTGGCCGAGGAGCAG
GACTGACACGTGCTAAAACTTCATTTTAATTTAAAAGGATCTAGGTGAA
GATCCTTTTTGATATCTGCAGC SEQ ID NO:214 contig44 477 bp
Seqids       25026_300072_1 original 154
             25608 new
             52456
TTTTTTTAGWTWTTAAAGAGTACAACAATGTTGATTAACTTAGTTCCTCT
GTACATTGAAGATTCCAAATTTGTTCATGGAGCTACAACGGTTCAACAAT
AATTCAAGCTCAAAAACCAAGAACTCTAAGATGAAACACACTCACAGACA
GACATGAAAGTGATGGAAGATAGATAGGTATGAGATCATAAGTCTGTCTT
CACTCTTTAGTTGAAGGTTTGGACAATAGTGTTGTGCCATGGGTCAGACA
AGTGCTGCAACAGATTCTCAAATGGTCCTTTTCCAGTCACATTGTGTTGA
ACCACAAACCCTAAGAATGCCAACATCGCCAACCTCCCGTTTGCTAGCTC
TTTCTCCTTGGCCTCTTGCGTAGGAGCAAAGTTAAGCGGGTTAAAGATTC
CACCAGGGTAACCAACTTCACCCTTAGGTAAGCTGTATTGCTTAAAGATA
GGGTCTTGGTTCACACTTCCTGGGTTC SEQ ID NO:215 contig46 613 bp
Seqids       25687_300076_1 original 154
             22131 new
             52089
CCCACGCGTCCGAAAACAATCGAGAACCACTCTTTCGTGTCGCAATAACA
ATMMSAMRSRWMSRAAAAGAAAACCAGAGATGGCGATGACGACAGCATCT
ACGGTATTTGTTCTACCGGCCAATGTCACCTCGGTCGCCGGCGCTTCGTC
GTCCAGGAGCTCCGTGTCTTTCTTGCCGATGAGAAACGCCGGTTCTAGGC
TCGTAGTCAGGGCAGCCGAAGATCCTGCTCCGGCTTCCTCTTCTTCAAAA
GATTCTCCGGCAGCTGCCGCTGCTCCGGATGGAGCTACTGCCACCAAACC
CAAGCCACCACCGATTGGTCCTAAGAGAGGGTCTAAGGTCAAGATTCTAA
GGAGAGAATCCTATTGGTTCAAGAACGTTGGATCAGTTGTTGCCGTTGAT
CAGGACCCTAAGACTCGATACCCGGTTGTGGTCCGGTTCGCAAAAGTCAA
TTACGCCAACATATCGACCAACAACTATGCATTGGATGAGGTCGAAGAAG
TTGCAGCTTAAATGGGAGAATTCAAAAACTCTGTGTATTYTATACCGGTT
TATCCGTTTGTAACTTGACCCAAACCGTATGTACCGCAAAAGTTYMCCAA
TTATTTCTCCTCC

Figure 4n

SEQ ID NO:216 Contig51   881 bp
Seqids        25024_300072_1 original 154
              25066_300074_1
              6153   new CCCACGCGTCCGTCATCTTCTTCTTCACTCGCCTCAATTTTTGTTCCCTT
CTTCTTCTATAATTCAACTGTGAATTTCACCGACGAAACAAAAAAGAGAG
AGAGAGAGAGAAACGATGAGTTCTCAGATTTCGGAGATTGAACAAGAG
CAGCTGATCGAGAAGCTTGAGATCTTCAAGATCCATGGCAGAGACAAACG
TGGCCGTAAGATCCTTCGTATTATCGGAAAATTCTTCCCAGCTCGATTTC
TGTCACTGGATGTGTTGAAGAAGTATCTAGAGGAGAAGATATTTCCTCGA
TTAGGTAGAAAACCATTCGCCGTACTCTACGTCCACACCGGCGTACAGAG
AAGCGAGAACTTCCCAGGTATCTCAGCTCTACGAGCGATCTACGACGCAA
TTCCGGTAAACGTCAGAGACAATCTTCAGGAGGTTTACTTCCTCCATCCA
GGTCTTCAATCACGTCTCTTCCTCGCCACCTGCGGCCGATTTCTATTTTC
CGGCGGGTTGTACGGGAAGCTGAGGTACATAAGCAGAGTTGATTATCTGT
GGGAACATGTGAGGAGGAATGAGATAGAGATGCCGGAGTTTGTATACGAT
CACGATGATGATCTGGAGTATCGTCCGATGATGGATTACGGTCAAGAAAG
CGATCACGCGAGGGTTTTCGCCGGAGCCGCCGTGGATTCATCAGTCTCAA
GTTTCTCCATGAGGTGTATCTCATAGCGTAAAAGGCTAAAACTCCACCCA
CTAGATATCGGATCGTATCTTATAAACCATATAATATACGAATACGATTA
ATAATATATCAAAAGATTGGAAATAGGTGTGCTTTTTGAAATTAGTGAG
CGTTTTTTATGGAAAAGAAAAGAAAAGAAAG

Figure 5a

SEQ ID NO:217 190867 (homologous to 45891) 561 bp
CCCGGCTACTGCGCCTCCACTCCCACCCGTAGCGCCTCCCCGGGAACCCACTCCCAGCCGCCGCCGCCG
CCACCTGCAACCGAGGGCTCGCCATGCCGCCGAAGCTCGACCCGACGCAGGTGGTGGATGTGTTCGTCC
GCGTGACCGGAGGCGAGGTGGGCGCGGCGTCGTCCCTTGCCCCCAAGATCGGCCCTCTCGGTCTCTCCC
CCAAGAAGATCGGTGAGGACATCGCCAAGGAGACGGCCAAGGACTGGAAGGGCCTCCGCGTCACCGTCA
AGCTCACCGTCCAGAACCGTCAGGCGAAGGTGTCCGTCGTCCCCTCCGCCGCGGCGCTCGTCATCAAGG
CCCTCAAGGAGCCCGAGCGGGACAGGAAGAAGGTCAAGAACATCAAGCACAGTGGTAACATCAGCCTCG
ACGACGTCATCGAGATCGCCAGGATCATGAGGAACAGGTCCATGGCCAAGGAGATGGCCGGGACCGTCA
AGGAGATCCTTGGGACCTGCGTCAGCGTTGGGTGCACCGGCGACGGCAAGGACCCCAAGGATCTGGAGC
AGGAGATCT

SEQ ID NO:218 187837 (homologous to 25080) 462 bp
CAAGAAGAAATTTATTGCACGATCAAAATCATACCATGGATCAACACTAATATCAGCTAGTCTATCCGG
TCTTCCTGCACTGCATCAGAAGTTTGATCTGCCTGCACCTTTTGTTCTGCACACGGACTGCCCTCACTA
CTGGCGCTTCCATCTTCCTGGTGAAACATAAGAAGAATTTGCAACTAGACTTGCCAATAATTTAGAGGA
ACTTATCCTCAAAGAAGGACCAGAAACAATTGCTGCATTCATTGCAGAGCCTGTGATGGGTGCTGGTGG
TGTCATACCTCCTCCAAAGACCTATTTTGAAAAGGTCCAAGCGATCGTTAAGAAGTATGACATCCTTTT
CATAGCAGATGAGGTCATTACTGCATTTGGAAGGTTGGGAACCATGTTTGGAAGTGATATGTATAACAT
CAAGCCAGATCTAGTCTCCATGGCCAAGGCGCTTTCATCTGCCTATGT

SEQ ID NO:219 187756 (homologous to 45808) 443 bp
GGCGCTCAAGTTCTCGAACGCGTGCGGAGCCATCTGCACCACCAAGAAGGGTGCCATCCCGGCGCTGCC
CACCGTCGCCGTCGCGCAGGAGCTCATCAGCAAGGCAGCCAACTAGAGCTCCTCGGTTTCGTCGTCGAT
CGCCGCCATTGGGGGCCTCGGAATTTTAGGTCGATTTAATTTAGTTGCTGCTTCGTTTTAGACAAGGAA
GAGGAGGGGCTTGGGTGTGTTCATGTCTGTCTTTTGTGTGCTAAGTTAGTTGCTTCCGTGTGAGAACTT
TTGGCGTTTATTTTTACTATTATTATTAATAAGAAGCTCTTGGATTTGCGGTGGATATTTTGGTCTGAA
TTTGTGTAATGAGGCAGCTACTTGGCGAAATTTATTGTGTCATGTCTTTGTTCAGAGGAAAAGAAAATC
TTTTCGTGTGCTCTGTTTCAAATCAGTTA

SEQ ID NO:220 187506 (homologous to 20023) 466 bp
CCCACGCGTCCGATTTGCTGCTGCCATTGAGTCCCCAAAATCTTGGGTGATGAATGTCGTGCCTACGAT
TTCAAAGATGTCAACTCTAGGGGCTATTTACGAGCGAGGATTGATTGGCATATACCACGACTGGTGCGA
AGCTTTCTCTACTTACCCAAGAACGTATGATCTTATCCACGCTAGTGGCCTTTTCACCCTGTACAAAAA
CAAGTGCAACATGGAAGACATCCTACTGGAGATGGACCGCGTCCTGAGGCCAGAAGGCGCCGTCATAAT
GAGGGACGATGTCGATATCCTGACGAAGGTGAACAGGCTCGCCCTCGGCATGAAATGGAACACGAGGCT
GGTCGATCACGAGGACGGCCCAATGGTGCGTGAGAAGGTGCTGTATGCTGTGAAGCAGTACTGGGTAGG
CGGAAACCAGACTGCAGCAGCTGCAGCATGAAGCAGGCGTAAATCCTAACAC

SEQ ID NO:221 186815 (homologous to 21627) 426 bp
CCGAACCCTAGCCTGCTTCTCCTCCTCCTCCCCGCCGCCGCCGCCGCGAGCACAGACGACGCAGCCATG
TCCGGGAGGAAGAAGACGCGAGAGCCCAAGGAGGAGAACGTGACGCTCGGCCCCACGGTCCGCGAGGGC
GAGTACGTCTTCGGCGTCGCGCACATCTTCGCGTCGTTCAACGACACCTTCATCCACGTGACGGATCTG
TCCGGCAGGGAGACGCTCGTCCGCATCACCGGTGGCATGAAGGTGAAAGCTGACCGTGATGAGTCATCC
CCTTATGCTGCCATGCTTGCATCCCAGGATGTTGCACAGAGATGCAAGGAGCTTGGAATTACTGCTCTG
CACATTAAGCTCCGTGCTACTGGTGGAAACAAGACAAAAACTCCTGGTCCTGGTGCTCAATCTGCGCTT
AGAGCTCTTGCA

Figure 5b

SEQ ID NO:222 184629 (homologous to 23730) 482 bp
AACAAAGCATTGCGATGGTCCCTGCGGATGCTAACGCAATGTGATTTCTGCCCAGTGCTCTGAATGTCA
AAGTGAAGAAATTCAACCAAGCGCGGGTAAACGGCGGGAGTAACTATGACTCTCTTAAGGTAGCCAAAT
GCCTCGTCATCTAATTAGTGACGCGCATGAATGGATTAACGAGATTCCCACTGTCCCTGTCTACTATCC
AGCGAAACCACAGCCAAGGGAACGGGCTTGGCAGAATCAGCGGGGAAAGAAGACCCTGTTGAGCTTGAC
TCTAGTCCGACTTTGTGAAATGACTTGAGAGGTGTAGGATAAGTGGGAGCCGTCTTTGGCGGCGAAGGT
GAAATACCACTACTTTTAACGTTATTTTACTTATTCCGTGAGGCGGAAGCGGGGCATCGCCCCTCTTTT
TAGATCCAAGGCTAGCTTGCTATGCCGATCCGGGCGGAAGACATTGTCAGGTGGGGAGTTTGGCTGGG

SEQ ID NO:223 183064 (homologous to 25103) 478 bp
GAATTCAGGATAGCATTCATTCTGGAACAGGTTCGTCTGTGTTTGGACCGTCAAGATTATGTGCGAGCT
CAGATCCTGTCAAGGAAGATTAGTCCACGAGTTTTTGACATTGATGCTTCAAAAGAAAAGAAAAAGCCT
AAGGAGGGTGATAATGTTGTTGAAGAGGCTCCTGCTGATATACCTTCTCTCTTAGAGTTGAAGCGGATC
TATTATGAACTAATGATAAGGTACTACTCCCACAACGATGATTACCTTGAAAAATGCCGTTGCTACAAA
TCAATATATGATATTCCATCTGTTAAAGAAGATCCGGCTCAAATGGTTCAGGTTTTAAGAAAGATCTGC
TGGTTCATAATCTTGGCGAAACACGATCCAATGCAGTCAAGCCTCCTTAACTCCACTTTGGAAGATAAG
AATCTCTCTGAGATCCAGAATTTTCGGGTACTACTGAAGCAGATCGCCACAATGGAGGTCATCC

SEQ ID NO:224 181845 (homologous to 21604) 475 bp
GAATTCAGGTGAACGAAATGGCAAATACTCTATCCATGGCTGGAGTTAACCATTCAATCATTTACAAAA
CCACAGCCATCTCTTCTTCTTCTTCATCTCAAGCTTCATCCCTTGGATGGACAAACAAGTTTCAATTCA
CCAAAAATCAATGGATGGGTACATCAAAATTCTCATCTTTAAGAAGAACTAGTACCACCAGCACCACAT
TAGTTCATGCTGGTTCTTCTAAGGCAGATGATTCTGCCCCTTCTGGGATGTCTCTTGAAGACGCTTTAA
AACTTTTGGGTGTATCTGAAGGTGCTTCATTTGATGAAATACTTCGTGCTAAGAATTCAATTCTATCCA
CCTGTAAAGATGACCAAGACGCTATCGCCCAGGTAGAGGCTGCATATGATATGTTGCTTATGCAGAGCC
TAACGCAGCGTCGAGCTGGGAAAGTTTTAAGTAATAGCATTCGTTATGCTGATGCAAAGCC

SEQ ID NO:225 181556 (homologous to 25162) 471 bp
GAATTCTCGCAGATCTCTATATAGGTGATTTTTGTTATGTTAAATACCAACTTTTTTTGAACTGTGATA
GAAAGGTACTAATCTTATTTTAAATATGAGGTTTATTTATTGGAATGTGCAAGGTTATGGTAACAAGGA
CACTAGAAAACACTTAAACAATTTAGTTCATACCAATGATCCTAATGTGATTTTCTTATCTGAAACTAA
AATTAGTTTCAAGAAAATGTCTAGATTCATCCAGCCGTTAAAATATCATAACTTTTTCATTGTTAATCC
TATAGGACTGTCTGGTGGTCTCTGTCTTCTTTGGAAACATGGAATGAATTTGGAAATCATCAGTTCCCA
ATTCAATGTCATAAATTGTGTATTTCAATTTGATGGCAGGTCTAAGATTGCCTTTTCTTGCATGTATGG
TGCTTTTTGTAATGGTAATAGGGATGCCCAATGGGATTTTATTAGACAATTTAGACA

SEQ ID NO:226 174962 (homologous to 34406) 467 bp
CCCCCCTGCTCAGGCTCAGGGGAGGGATGCAGATCTTCGTCAAGACCCTGACCGGCAAGACCATCACCC
TCGAGGTCGAGTCCTCGGACACGATCGACAACGTGAAGGCCAAGATCCAGGACAAGGAGGGCATCCCCC
CGGACCAGCAGCGTCTCATCTTTGCTGGCAAGCAGCTGGAGGATGGCCGCACCCTTGCCGACTACAACA
TCCAGAAGGAGTCCACCCTCCACCTTGTGCTCAGGCTCAGGGGTGGTATGCAGATCTTCGTCAAGACCC
TGACCGGCAAGACCATCACGCTTGAGGTCGAGTCCTCGGACACGATCGACAATGTGAAGGCCAAGATCC
AGGACAAGGAGGGTATCCCCCCGGACCAGCAGCGTCTCATCTTCGCCGGCAATCAGCTGGAGGATGGCC
GCACCTTGGCTGACTACAACATCCAGAAGGAGTCCACCCTTCACCTGGTTCTC

Figure 5c

SEQ ID NO:227 174877 (homologous to 21627)      434 bp

CCCCCCCCCCGGGAGCTAGGGTTGGATCGCCGCCGCCGCCGCCGCCGCCGCTTCTCCACTCTCCC
CTGCCCCGTCGCCGTCGCCACCGCCGCCGCCATGTCCGGGAGGAAGAAGACACGGGAGCCCAAGGAGG
AGAACGTCACCCTCGGCCCGACCGTGCGCGAGGGCGAGTACGTCTTCGGCGTCGCCCACATCTTCGCCT
CCTTCAACGACACCTTCATCCATGTCACCGATCTGTCCGGGAGGGAGACGCTCGTCCGCATCACTGGTG
GCATGAAGGTTAAAGCTGATCGCGACGAATCTTCCCCTTATGCTGCTATGCTTGCTTCACAGGATGTTG
CTCAAAGATGCAAGGAGCTTGGAATAACTGCTTTGCATATCAAGCTCCGTGCTACTGGTGGTAACAAGA
CAAAAACCCCTGGTCCTGGT

SEQ ID NO:228 168562 (homologous to 38919)      477 bp

GAATTCAGAGCTCAGACACAATTGACAACGTTGGGGCTAAGATTCAAGACAAGGAAGGAATTCCTCCAG
ACCAACAACGTTTGATCTTCGCCGGAAAGCAGTTGGAAGATGGAAGAACTTTAGCTGACTACAACATCC
AGAAGGAATCAACTCTCCATCTTGTCCTTCGTCTTAGAGGTGGTATGCAAATCTTTGTCAAAACCTTGA
CTGGTAAGACCATCACTTTGGAAGTCGAGAGCTCTGACACCATTGATAACGTTAAGGCTAAGATTCAAG
ATAAGGAAGGAATTCCTCCAGACCAGCAACGTTTGATCTTCGCCGGAAAGCAGTTGGAAGATGGTCGTA
CTCTTGCCGACTACAACATCCAGAAGGAGTCTACTCTCCATTTGGTTCTTCGTCTCAGAGGTGGTATGC
AGATTTTCGTCAAGACCCTTACTGGAAAGACCATCACCTTGGAGGTTGAGAGTTCCGACACCA

SEQ ID NO:229 167955 (homologous to 121540)      471 bp

GAATTCACGACATCAAGTTGAACAATGCAAGGCTTGCAGAGGAAAAGCATGTGCCTATGTACGATGAAT
TGGCTGCTAAAGACAATGTTGAGTACATTGCTGGAGGTGCAACTCAAAATTCTATCAGAGTTGCTCAGT
GGATGCTACAAACTCCTGGTGCCACTAGTTTCATTGGTTGCATCGGAAAGGATAAATATGGTGAAGAGA
TGACGAAAAACTCAAAGCTTGCTGGTCTTAACGTTCACTACTACGAGGATGAGACCGCAGCTACTGGTA
CGTGCGCTGTTTGTGTTGTTGGTGGCGAGAGGTCTCTCATTGCCAACCTGGCCGCAGCAAATTGCTACA
AATCCGAACATTTACAGAAACCAGAAAACTGGGCTTTGGTTGAGAAGGCTAAATACTATTACATTGCTG
GATTTTTCCTCACTGTTTCCCCCGACTCCATTCAGCTTGTAGCAGAGCATGCCGCTA

SEQ ID NO:230 167907 (homologous to 115126)      474 bp

CGACGAATTCGTAACCCTAAGAACCCTTACTGGTTTGACAGAGATAGATTCGTTCTTTCTGCTGGTCAC
GGTTGTATGTTGCAGTATGCTTTGCTTCATCTTGCTGGTTACGACAGTGTTACGACAGAAGATTTGAAG
ACTTTCCGTCAGTGGGGAAGCAAAATTCCTGGTCACCCCGAGAACTTCGAGACTCCTGGTGTTGAAGTC
ACTACAGGTCCCCTTGGACAAGGTATTGCTAATGCTGTTGGATTGGCACTTGCCGAGAAGCACTTGGCT
GCCCGTTTCAACAAGCCTGACAGCGAGATTGTAGACCATTACACATACTGTATTCTTGGAGATGGATGT
CAAATGGAGGGAATTGCAAATGAAGCTTGTTCGCTAGCTGGACATTGGGGACTTGGAAAGCTGATTGCT
TTCTACGATGACAACCACATCTCTATTGATGGTGACACAGAGATTGCTTTCACAGAGAGT

SEQ ID NO:231 167877 (homologous to 42167)      470 bp

GAATTCAAATCAAAAATCAATATTATCAACCGTTATCCAGTAAAAGTTGGAATCCTAGCATCAGAAGTA
TCGTCCATTACTAGACTTACTCTTGACACCTTCTGACAAGCTTCAGCAGAAGGCCAGAGAGGAAACCT
TACATTAGGATCATAAGAAACCAAACCATCAACAAAAACCTCATAAGAAAGCAAACCAGCCACAAAAAC
CAAACCAGCAATGGTTGGAGAGGCCCGAGGAGAGAGAGATTAATTTGTAATCAATTTGTTTGTTTGCTG
ATAGCCCATGTAGGGCTATTATGTGGGCATCCAAACCATCACTGGTTGGCGATATGTATTGAAACCTAA
TATAATATATGGAAGATCATTGAAATCCCTTTTTCCATTACGGGACTATTCGTGGTCAGTTCGCGAAAG
AGAGGATATCTTATTATAATGCTACGTCGATCAGCACCGCCCTTACAAGCACACCA

Figure 5d

SEQ ID NO:232 167345 (homologous to 105039) 468 bp
GAATTCACATTGAAATCTTCATTGATTTCGGCGATTGCATCATCACGATCTAATCGTGTCAATACACCA
TCGTTATCGAGATCGTTGGTGGTTCGTGCTTCAGCTGTTGAGACTTTGGAAAAGACAGATACAGCATTA
GTTGATAAATCAGTGAATACTATTAGATTTCTAGCAATTGATGCTGTCGAGAAAGCTAATTCAGGTCAT
CCTGGTTTACCTATGGGATGTGCGCCCATGGGTCATATTTTATACGATGAAACCATGAGATATAACCCT
AAGAACCCTTACTGGTTTAACAGAGATAGATTCGTTCTTTCTGCTGGTCACGGTTGTATGTTGCAGTAT
GCTTTGCTTCATCTTGCTGGTTACGACAGTGTTACGACAGAAGATTTGAAGACTTTCCGTCAGTGGGGA
AGCAAAATCCCTGGTCACCCCGAGAACTTCGAGACTCCTGGTGTTGAAGTCACT SEQ ID NO:233 137931 (homologous to 25016) 458 bp
CAGGGGAGAAAGCCCTAATCTCAAGGCCGCGGCTGTGAGCGCTCCTCCCGTCTCTCCCCCAACCCGCCG
CCAGCCACCGAGCTCGCCACCGTCTCCGTTGCCTCGCCGTGCTCTAGGTTCTCGGATGGAGGCCGAGGC
GGCGGCGAACAGGGCGCGGGAGAGCGGTGACGCGGCGGCGGCCGGTGCCGGCGAGCAGGCGGGTATCTC
TGCCGTCATCCCTGGATGGTTCTCCGAGATTAGCCCCATGTGGCCTGGTGAGGCACACTCATTGAAGGT
CGAAAAGGTACTATTCCAAGGAAAGTCGGACTACCAAAATGTGATGGTGTTTCAGTCCTCCACGTACGG
CAAGGTGCTTGTGCTGGATGGAGTGATTCAGGTCACTGAGAGGGATGAGTGTGCTTACCAAGAGATGAT
TACCCACCTCCCCCTTTGCTCTATCAAAGATCCCAAAAAGGTGT SEQ ID NO:234 137148 (homologous to 45853) 466 bp
CGCTCCTCCGTCCTCCTCTCTCTCCTCAAAGGGAACATCGAGAGAGAGAGAGGTCTAAAACCCTAAC
CCCCGAATCGAATCTCGTCGGAAGCCGCCGCCGCCGCCGACGACGACGACGCCCGCGACGCCATGG
ACATGGGAGCGATGAGCGATCCGGAGAGGATGTTCTTCTTCGACCTGGCATGCCAGAACGCCAAGGTCA
CCTACGAACAGAACCCGCACGACGCCGACAATCTCACGCGGTGGGGAGGCGCGCTGCTCGAGCTCTCGC
AGATGCGGAACGGCCCCGAGAGCCTCAAGTGCCTAGAAGATGCGGAATCCAAGCTGGAGGAAGCACTGA
AAATTGATCCCATGAAGGCGGATGCGCTTTGGTGCTTGGGAAATGCACAGACCTCTCATGGATTCTTCA
CTTCAGACACTGTCAAGGCCAATGAATTCTTTGAAAAGGCAACCCAGTGTTT SEQ ID NO:235 135552 (homologous to 38919) 459 bp
CGGCAAGACTATCACCCTCGAGGTGGAGTCCTCTGACACCATCGATAATGTCAAGGCTAAGATCCAAGA
TAAGGAGGGCATCCCCCCGGACCAGCAGCGTCTCATCTTCGCTGGCAAGCAGCTGGAGGATGGCAGGAC
CCTTGCTGACTACAACATCCAGAAGGAGTCGACCCTTCACCTTGTCCTCCGCCTCCGTGGTGGCATGCA
GATCTTTGTCAAGACTCTGACCGGCAAGACTATCACCCTTGAGGTGGAGTCTTCTGACACCATCGACAA
CGTCAAGGCCAAGATCCAGGACAAAGAGGGCATCCCCCAGACCAGCAGCGTCTCATCTTCGCCGGCAA
GCAGCTGGAGGATGGCAGGACCCTTGCTGACTACAACATCCAGAAGGAGTCCACCCTCCACCTTGTCCT
CCGCCTCCGTGGTGGCATGCAGATCTTTGTCAAGACACTGACCGG SEQ ID NO:236 131364 (homologous to 105039) 469 bp
GAATTCAAGAACATTGAAATCTTCATTGATTTCATGGATTGCATCATCACGATCTAATCGTGTCAATAC
ACCATCGTTATCGAGATCGTTGGTGGTTCGTGCTTCAGCTGTTGAGACTTTGGAAAAGACAGATACAGC
ATTAGTTGATAAATCAGTGAATACTATTAGATTTCTAGCAATTGATGCTGTCGAGAAAGCTAATTCAGG
TCATCCTGGTTTACCTATGGGATGTGCGCCCATGGGTCATATTTTATACGATGAAACCATGAGATATAA
CCCTAAGAACCCTTACTGGTTTAACAGAGATAGATTCGTTCTTTCTGCTGGTCACGGTTGTATGTTGCA
GTATGCTTTGCTTCATCTTGCTGGTTACGACAGTGTTACGACAGAAGATTTGAAGACTTTCCGTCAGTG
GGGAAGCAAAATTCCTGGTCACCCCGAGAACTTCGAGACTCCTGGTGTTGAAGTC

Figure 5e

SEQ ID NO:237 131193 (homologous to 30310) 336
bp
GAATTCAAGAATAAGAACAGAGGAGAAGGAAAAAGGAAAATCAATCCTTTATTCCAAAAGGCCACTCCA
GAAGAGAGGAATGTTCGATTTGGTGTCAAAGAGCATGCTATGGGAGCCATCTGTAACGGAATTGCTCTC
CACAGTCCTGGTTTTGTCCCCTACTGTGCTACCTTCTTTGTTTTCACCGATTACATGAGAGGTGCCATG
AGAATTTCAGCTTTATCTGAAGCTGGAGTCATTTACGTCATGACCCACGACTCTATTGGTCTTGGAGAG
GATGGTCCAACTCATCAGCCCATCGAACATTTGGCAAGCTTTAGAGCCATGCCTAACATT

SEQ ID NO:238 131037 (homologous to 105039) 472
bp
GAATTCAAGACAGATACAGCATTAGTTGATAAATCGGTGAATACTATTAGATTTCTAGCAATTGATGCT
GTCGAGAAAGCTAATTCAGGTCATCCTGGTTTACCTATGGGATGTGCGCCCATGGGTCATATTTTATAC
GATGAAACCATGAGATATAACCCTAAGAACCCTTACTGGTTTAACAGAGATAGATTCGTTCTTTCTGCT
GGTCACGGTTGTATGTTGCAGTATGCTTTGCTTCATCTTGCTGGTTACGACAGTGTTACGACAGAAGAT
TTGAAGACTTTCCGTCAGTGGGGAAGCAAAATTCCTGGTCACCACGAGAACTTCGAGACTCCTGGTGTT
GAAGTCACTACAGGTCCCCTTGGACAAGGTATTGCTAATGCTGTTGGATTGGCACTTGCCGAGAAGCAC
TTGGCTGCCCGTTTCAACAAGCCTGACAGCGAGATTGTAGACCATTACACATACTGTA

SEQ ID NO:239 130769 (homologous to 45866) 471
bp
GAATTCATTTAGCAAAGATGCTTGTCTACCAGGGGCTTCTTACAGGTGATGAGCTTCTCTCGGATTCGT
TTCCTTATGAGGAAATTTGTGATGGAATGTTATGGCAAGTTGAGGGGAAGTGGGTAGTTCAAGGAGCTG
TTGCTGTTGACATTGGTGCTAATCCTTCTGCTGAAGGTGCTGATGCTGATGAGGGTGTTGATGACGCAG
CTGTGAAATGTGTTGATATTGTCGACACTTTTAGACTCCAGGAACAACCACCTTTTGACAAGAAACAGT
TTGTTGGATATATCAAGAAACTTATCAAGACTCTTACACCCAAGCTGGGTGAAGAGGAGAAAGCAAAAT
TCAACAAAGGCATTGAGGCAGCAACCAAGTACCTTCTTCCAAAGCTTAAGGACTTGCAATTTTTTGTCG
GGGAGAGCATGGCCGATGATGCTACAATTGTGTTTGCATACTACAAGGAAGGTGCTG

SEQ ID NO:240 130517 (homologous to 115126) 483
bp
GAATTCAAGACAGATACAGCATTAGTTGATAAATGAGTGAATACTATTAGATTTCTAGCAATTGATGCT
GTCGAGAAAGCTAATTCAGGTCATCCTGGTTTACCTATGGGATGTGCGCCCATGGGTCATATTTTATAC
GATGAAACCATGAGATATAACCCTAAGAACCCTTACTGGTTTAACAGAGATAGATTCGTTCTTTCTGCT
GGTCACGGTTGTATGTTGCAGTATGCTTTGCTTCATCTTGCTGGTTACGACAGTGTTACGACAGAAGAT
TTGAAGACTTTCCGTCAGTGGGGAAGCAAAATTCCTGGTCACCACGAGAACTTCGAGACTCCTGGTGTT
GAAGTCACTACAGGTCCCCTTGGACAAGGTATTGCTAATGCTGTTGGATTGGCACTTGCCGAGAAGCAC
TTGGCTGCCCGTTTCAACAAGCCTGACAGCGAGATTGTAGACCATTACACATACTGTATTCTTGGAGAT

SEQ ID NO:241 130065 (homologous to 29267) 472
bp
GAATTCAAGAGCCATTGGAGCCGCCATACTGCTGAAGGTGCTGCCCTAGAAGCTGAATGGACAGCTAAA
TTTGCAGAGTACGAAAAGAAGTACTCAGAGGATGCTGCAGAATTTAAGTCCATCATTACTGGTGAATTC
CCTGCTGGTTGGGAGAAGGCTCTTCCTACCTACACTCCGGAGATCCCAGCTGATGCCACCAGAAACCTA
TCCCAGACATGCCTTAATGCACTTGCTCCAGTCCTCCCTGGTCTTATTGGTGGTAGTGCAGATCTCGCT
TCCTCCAACATGACCTTGATGAAAATGTTCGGAGATTTCCAAAAGGCCACTCCAGAAGAGAGGAATGTT
CGATTTGGTGTCAGAGAGCATGCTATGGGAGCCATCTGTAACGGAATTGCTCTCCACAGTCCTGGTTTT
GTCCCCTACTGTGCTACCTTCTTTGTTTTCACCGATTACATGAGAGGTGCCATGAGAA

Figure 5f

SEQ ID NO:242 129468 (homologous to 25162) 469
bp
GAATTCACATTACTGAAATCTGGTGATATTTTCGTTTCCTTTTGTTTTTACTTTTAAATAGCTTAAAAA
ATCTGTGTTATTTGATAACAGGAGATTCTCTCCATTTTAACTTCTGTTTGATCATTTCTGGTGCTAAGG
TCAATTTAGTATTATGAAAATCCTAGCTTGGAATCTCCAAGGCTGTGGTACTAAAAAAACAAAACAACA
CTTTGATTTTTGATTAAATCGGAAAACCCTGATGTGGTGTTTTATCAGAAACAAAAAAGAAAAGATC
TGTTGTAAGACAATTTTTGTCATATTTTCCAAATGTGTTCATTGTTGACCCAGTGGGCATAGCAGGAGG
GTTAGCTATGGCATGGGTAGACGGTTTTAATTTTGATATAGTTCACTCTAGTGTAAACATGATTAACGT
CCTTGTTAAAACCAATTTCTCTGATAAAGAATGGTTGTTAACAGGATTTTACGGC

SEQ ID NO:243 128842 (homologous to 45866) 463
bp
CCGATCTTCTCTCCGGGGATGAGCTCCTTGCGGATTCATTTCCGTACACTGAACTTGAGAATGGAGTGC
TTTGGGAAGTACAAGGGAAGTGGGTTGTTCAGGGAGCTGTTGATGTGAACATCGGGGCGAATCCATCTG
CTGAAGGTGCAGATGAAGACGAAGGTGTTGATGATCAAGCCATCAAGGTTGTTGATATTGTTGACACTT
TCAGGCTTCAGGAGCAACCTTCTTTTGACAAGAAGCAGTTTGTTGCCTACATGAAGAAATATATCAAGA
GCCTAACACCCAAGTTAGGCGCAGAGCAGGAAGAAGTTTTTAAGAACAACATTCAAGGAGCCACCAAGT
ACCTTTTGTCAAAGCTCAGTGACCTTCAATTCTTTGTTGGTGAGAGCATGGCTGATGATACTGGAATGG
TGTTTGCCTACTACAAGGATGGCGCCACTGATCCAACCTTTTTGTACCT

SEQ ID NO:244 128364 (homologous to 25118) 467
bp
CCCCCTCGGATTCTTATCCCCTTCAAATCGAGGAGGATTGATGACAGCAATGTTGCTTCTCTGGGCATT
CATGGGTGTTTTGCTGGGTATGCTTCAGCCCGCCTTTACAAGATGTACAAAGGAACTGAGTGGAAAAA
AATTACTCTTAAGACAGCACTCATGTTCCCCGGCATTGTTTTTGTTCTTTTCTTTGTGTTGAATGCTCT
AATTTGGGGAGAGAAGTCATCTGGGGCAGTGCCATTTGGAACCATGTTTGCATTAGTATTTTTGTGGTT
TGGCATCGCAGTGCCACTCGTTTTTGTTGGTAGTTATGTAGGTTTTAAGAAGCCAGCCATTGAGGATCC
TGTTAAGACAAATAAGATCCCTCGACAGATACCAGAGCAAGCCTGGTACATGAATCCAGTTTTCTCTAT
CCTTATTGGTGGCATACTTCCATTTGGAGCTGTATTCATCGAGCTATTTTTCA

SEQ ID NO:245 127560 (homologous to 21627 ) 465
bp
CCCCCCCCCGAACCACAAACTAGGGTTATTGGCTTGCTGTTTCAGTATCTATTGAGCTTCTCTCTACCA
ATCCCAGCCGAAGCCATGTCGAGGAGAAAGACTAGGGAGCCAAAGGAAGAGACAGTAACACTTGGACCA
GTAACCAGGGAGGGTGAATTGGTGTTCGGTGTTGCTCACATTTTTGCCTCTTTCAACGATACTTTTATT
CATGTGACTGATTTGTCTGGAAGAGAAACTATGGTTCGCATTACTGGTGGAATGAAGGTAAAGGCTGAT
AGAGATGAATCTTCTCCATATGCTGCCATGCTTGCAGCTCAAGATGTGTCACAGCGATGCAAGGAACTT
GGAATTAATGCTCTTCACATTAAGCTTCGGGCTACAGGAGGCAACAAGACTAAGACTCCTGGTCCTGGT
GCCCAGTCTGCTCTTAGGGCTTTGGCTCGATCTGGCATGAAAATTGGACGT

SEQ ID NO:246 120590 (homologous to 20023) 475
bp
CAAGAAGTTGCTCCCAGCTATTGGAACTGAGAAGATCAGAAATGTGATGGACATGAACACCCTGTACGG
AGGTTTCGCTGCTGCTCTGATTGAGGATCCACTTTGGGTCATGAATGTGGTTTCCTCTTATGCTGCAAA
CACGCTTCCTGTGGTCTACGACAGAGGTCTTATCGGAACATTCCATGACTGGTGTGAGGCCTTCTCAAC
GTATCCTCGAACATATGATCTCCTTCACCTTGACGATCTCTTCACTTCTGAAAGTCATAGATGTGAAAT
GAAGTATGTGCTGCTGGAAATGGATCGTATTTTGCGGCCCAACGGGTATGCAATTATCCGGGAATCCAG
CTACTTTGTAGATGCAATTGCCACTATGGCTAAGGGCATGAGATGGAGCTGTCGTAAAGAAAACACGGA
ATATGGTGCAGAGAAGGAGAAGATATTGATTTGTCAGAAGAAGCTGTGGTATTCAAAGCAG

Figure 5g

SEQ ID NO:247 120232 (homologous to 25032)  473 bp

AGCCTTGTTTGGATCACCACCATTTGTGTCTCACCCAATTGCCAGAATCAACTTCTCTTCATCCTCACA
AACCCCTCCTCCTCCTCAGCCACCAAATCAACCTCCACAACCACAAACTCCACCACCATCTCAAAATTT
AAGTGCAACTTCTTCAGATTCTCCATCACCAGTCACTGCAGCTAATGTGCAGCCACAAAAGCCTAGTAG
TAAACCTGCCCGCCTATCGACAACTGCAGAATCCACTGATTGGATTGCCTCTTCCTTAACAAGGAGATT
TGGCCTTGGTGCTGGACTTGCTTGGGCTGGTTTTCTTGCTTTTGGTGTTGTTTCTGAGCAAATCAAGAC
TCGCCTTGAAGTGTCTCAACAAGAAACAAATACAAGGGTTGTCGAGAAAGAAGAAGAAGTGGTCTTGCC
CAATGGGATAAGGTATTATGAACTGAAAATGGGCGGCGGAGCAACTCCCCGGCCAGGGG

SEQ ID NO:248 116494 (homologous to 27410)  457 bp

ATCCCGCCGCGCGGCCTCTCCATGGCGTCTACGTTCGTCGGCAACTCCACCTCCATCCAGGAGATGTTC
CGCCGCGTCAGCGAGCAGTTCACGGCCATGTTCAGGAGGAAGGCGTTCTTGCACTGGTACACGGGCGAG
GGCATGGACGAGATGGAGTTCACCGAGGCGGAGAGCAACATGAACGACCTCGTCTCCGAGTACCAGCAG
TATCAGGACGCCACCGCCGACGAGGCCGAGTACGAGGAAGAAGAGGACGCGATACAGGAGTAGAGACTG
TCTGGGCAATGGTACCTCGTATCCCCTGCCCATCGTTACCCTAATATGTTTGCCTGAACATCATCGCAG
TTGCATCACCATAGCTACCTCCGCACCTTAAAATTTGATGCTTGTTTGTATGCATGTTTGTACTGGTTC
CGTATGCTAAAGTCTTGGCTATTGATGTTCTGTTTGCTTGCTT

SEQ ID NO:249 114478 (homologous to 34406)  474 bp

CTTCATATTTCTCTCTCAAGATGCAGATCTTCGTGAAAACCCTAACCGGAAAGACCATCACTCTCGAGG
TTGAGAGTTCTGACACAATCGACAACGTAAAAGCCAAAATCCAGGACAAGGAAGGAATTCCCCCAGATC
AGCAAAGGCTTATCTTCGCCGGCAAGCAGCTTGAGGACGGACGTACCCTAGCCGATTACAACATCCAGA
AGGAATCTACCCTGCACTTGGTCCTCCGTCTGCGTGGTGGGATGCAGATTTTCGTCAAAACCCTCACTG
GCAAAACAATCACCCTTGAGGTGGAAAGTTCTGACACCATCGACAATGTCAAGGCTAAAATTCAGGATA
AGGAGGGAATTCCACCAGACCAGCAGAGGTTGATCTTCGCCGGCAAGCAGCTTGAGGACGGTCGTACCC
TTGCCGATTACAACATCCAGAAGGAGTCTACCCTTCACCTTGTCCTCCGTCTCCGTGGTG

SEQ ID NO:250 111774 (homologous to 20023)  484 bp

CACAGATGACCCAAGTGCTGCATGGTACTTCAAGTTGAAAAAGTGCGTGAGTAGGACTTTATCTGTCAA
AGGAGAATATGCCATTGGGAAAATTCCAAAATGGCCAGTGCGGCTGACAAAAGCTCCAGCTAGGGCAAG
TGTTACTAGAAATGGAATGGATGTGTTTGAAGCTGACTCAAGAAGATGGGCACGCAGAGTTGCATTCTA
TAAAAGTTCATTGAACTTGAAACTAGGAACTTCATCAGTTCGCAATGTCATGGACATGAATGCATTTTT
CGGAGGATTTGCTGCAGCGTTATCATCAGATCCAATCTGGGTGATGAATGTTGTTCCAGCACATAAGCC
TTTAACACTTGATGTGATTTTTGACAGAGGCCTTATTGGAGTTTATCATGACTGGTGTGAGCCTTTCTC
AACGTACCCTCGGACTTATGATCTGATTCATGTGGGAGCCATAGAATCTCTCATAAAGGATCCCGTTTC
T

SEQ ID NO:251 111725 (homologous to 25414)  438 bp

TCTACTAAATCCAGGGCTGGTTCTGTGGTAGCAAAGTATGGAGACAAGAGTGTATACTTTGATTTAGAG
GACTTGGGCAACACCACTGGGCAGTGGGACTTGTATGGTTCAGATGCACCTTCACCATACAATCCCCTT
CAGAGCAAGTTTTTCGAGACTTTTGCTGCTCCTTTCACTAAGAGAGGTCTGTTGCTCAAATTCCTGATA
TTGGGAGGTGGCTCAACTCTTGCATACTTCAGTTCAACAGCATCAGCGGATATATTACCAATCAAGAAA
GGACCTCAACTTCCACCCAAGCTTGGGCCACGCGGAAAGATCTAATTTCTTTTCAATCCAACTTTCTCA
ACCTTCATTTTGTAATTGATGTATCTGTCACCAGCTTGTAAGTATTCTTGAAGCCTACCTGAGACCTTT
GTTACAGAAGTTAAATCTTATTGC

Figure 5h

SEQ ID NO:252 111545 (homologous to 25032) 479 bp

```
CCCACGCGTCCGCCCACGCGTCCGACGGCCTGTGTTTGGATAGAGCCAATCAGAATAGTTTACTTGTTG
AAATCCTTTAGCCATGGCTGCAACGCCGAGCATTCAAGGATCATGCCTTATCAAAAATTCTTATCACCA
TTCAAATTCCTCCAATGCCCAGACTGACCAGCAGTTAAAGCAGGTGTTTTTACATTTACCAATTTCTAG
AAGATCTGTAATTCTTATCTCTGCGTTGCCCCTGAGCCTCAATTTGGTTCCTCAACCATCTTTGGCCAG
AGAAAGGCGCAATAAGAAGAACATCCCTATTGAAGATTATCAAACTAGCTCTGATGGATTGAAATACTA
TGATATTCTTGAAGGAAAAGGTCCTGTAGCTGAAAAGGGCTCCACTGTACAGGTACATTTTGAATGTCT
ATATCGTAATATTACTGCAGTTTCAAGTCGAGAATCCAAATTGTTGGCTGGAAATCGTATAATTT
```

SEQ ID NO:253 111460 (homologous to 21627) 481 bp

```
GAAGAGACTGTAACCCTAGGACCAGCTACCAGGGAGGGTGAGTTGGTCTTTGGTGTTGCCCACATTTTC
GCCTCTTTCAACGATACTTTCATTCATGTGACTGATTTGTCTGGACGGGAAACAATGGTCCGCATTACT
GGTGGTATGAAGGTGAAGGCCGACAGAGATGAATCTTCTCCTTATGCTGCTATGCTTGCTGCACAAGAT
GTTTCTCAACGATGCAAGGAGCTTGGAATTAATGCTCTTCACATTAAGCTTCGGGCTACTGGAGGGAAC
AAAACTAAGACTCCTGGTCCTGGTGCCCAGTCTGCTCTTCGAGCCCTTGCTCGATCTGGAATGAAAATT
GGACGCATAGAGGATGTTACTCCTATTCCCACAGACAGCACTCGCAGAAAGGGTGGTAGAAGGGGAAGG
AGGCTGTGAATTCTTCTCAGCAACATACTTGCTGCATGGCAAGAATATTTTGGTTTCGGGTCGCATC
```

SEQ ID NO:254 111456 (homologous to 45891) 478 bp

```
AAAACCTTAACCCTAGCCCATTCTCACTCCCTCGCTTCCATAGTGCCGCCCAAGTTCGATCCATCTCAG
GTGGTCGAGGTTTTCGTCCGAGTTACCGGCGGTGAAGTCGGAGCTGCGAGTTCACTCGCTCCAAAAATC
GGTCCACTTGGTCTCTCCCCTAAAAAAATCGGTGAAGACATCGCAAAGGAAACCGCCAAGGACTGGAAG
GGTCTCCGAGTCACAGTTAAACTCACCGTCCAAAACCGTCAAGCTAAAGTTTCCGTCGTTCCCTCTGCC
GCTGCACTCGTCATCAAGGCGTTGAAGGAGCCGGAACGTGACCGTAAGAAGACCAAAAACATCAAGCAT
AACGGTAACATCTCGCTCGATGACGTCATCGAGATCGCTAAGGTGATGAAGCCGAGATCGATGGCGAAG
GATTTGACTGGAACAGTGAAGGAGATTTTGGGCACGTGTGTATCAGTTGGCTGTACGGTAGATG
```

SEQ ID NO:255 110854 (homologous to 30087) 479 bp

```
CGGACGCGTGGGCACGCTGTAGTCTATCGATGCAATATCATGGGATACCAAGATACTCTCTACGTACAC
TCTCAGCGCCAATTCTATCGCGAGTGTGCTATCTATGGTACGGTTGATTTCATCTTCGGTAATGCAGCA
GTAGTCCTTCAAAACTGCAGCATTTACGCTCGAAAGCCCATGGATTTCCAAAAGAACACCATCACTGCC
CAAAACAGGAAGGATCCTAATCAAAACACTGGCATTTCAATCCATGCTTGCAAAATCGCAGCCACATCT
GACCTCGAGGCGTCCAAAGGAAGCTTCCCCACTTATCTTGGTCGACCGTGGAAGTTGTACTCTCGAACC
GTTGTCATGTTATCTAACTTGGGTGATCATATACACCCGCGTGGTTGGTTAGAGTGGAATGCTACATTC
GCACTTGAGACATTGTATTATGGCGAGTATATGAATTATGGACCGGGAGCAGCGGTAGGGCAACG
```

SEQ ID NO:256 109458 (homologous to 25124) 485 bp

```
AAGAGAGCTTACTCAGTTAGCCAGAACCGACACACCTTTGGGAAGCCTGTCAAGATATACAACTGAAAG
GTCTTGTAATTCACTGCCCGTGCAATGGAGCTAGCAAATGACCCTCTCATTATAGAAGGGACACATAAA
ATTTTGAGAGCTGTGGAATGACGACGAGGAAGGCAGAGAAGTGGCATCAAGTTGATTCAGTTACATAAA
GGGGACTTGCTTCTGTTTTCTCTAGGTGATTTCTTCAGTTTAGGCTATTATTCTTCCTTTGATTCGGTT
GGGGAAGCGAATGTTGTACTCGCTCCTTTCCTTGTTATCGTCGTCAATCTTCAGAGTTATTACTCTACT
GAGGGCTGGGCCTCTTCCCCCGTTTATTTCAAATCTTTTTTCTTTTCACGTCTTTTGCATAGAAGATTT
TGAAGGGAATGTATAGTTGATAGTACGGCACATTCTAGATTTGTGATATCTGTTAATCCTTTTCTCCCG
TC
```

Figure 5i

SEQ ID NO:257 109363    (homologous to 21604)    478 bp

GAACTTCTTAATACAAAGATATGCTGGTCATAAACCAAGGGGGGATGCAATTGAAGCAGCTCATGATAA
AATAATAATGCAGAAATTCTATGATAGGAAAAACCCAAAAATTGACTTTAAGAAGAAAGTCAGGGACAT
AAAACAATCTCGTGTTATGCAGGCTGTCACTAGCAGGTTCAGAACACCAGCTACAAATTTCATTGTGAA
AACTTCTATCGCTTTCATAGTCCTTGGAGCTCTCACAGTTCTCTTTCCTACTGAAGAAGGTCCAACGCT
TCAAGTTGCCATTTCCCTGATCACCGCCATATATTTCATTCATGATCGGTTAAAGAGCAAACTTCGAGC
TTTTCTATATGGAACTGGTGCTTTTATTTTCTCTTGGCTTTTGGGGACATTCTTGATGGTGTCTGTGAT
TCCTCCTATACTTAAAGGGCCAACGAGTTTGGAGGTGACAACTTCGTTGATTACGTATGTACTT

SEQ ID NO:258 108009    (homologous to 45837)    460 bp

CCCACGCGTCCGAGAAGAAATACGGAGAAAGAGCCATGGCAGGAGCTTGCTTATCTTCTTCTTCTTCTT
GTTGGAACTTGACTTCAAAATTCAATATCCTTTCTCTCAATGGACCTCACCCCAACGCTGCGGCATTGA
AGCCCCTCAGCTTCTCTGCCAACACTTCTCTCAATCTCTTCTCCAAAGGGAGTGTATCGCTGACTTCGG
TGCAAATGCCGTTTCGTCGTTCAATCGTTTGTGAAGCGGCTCCAACGAAGAAAGCGGATTCAGCAGCGA
AAAGGGCAAGACAAGCTGAAAAGAGGCGGCTTTACAACAAGGCTAAAAAATCTGAGGTCAAGACTCGGA
TGAAGACGGTTTTGGAAGCATTGGACGCATTGAAGAAGAAAACAGATGCACAGTCAGAGGAAGTTATTT
CTGTTGAGAAGTTGATCGCGGAGGCATATTCAGCAATCGATAAAGC

SEQ ID NO:259 107969    (homologous to 25414)    464 bp

GAATTCTGAAAATAGTTTTGGTAGTTTGGAGTGAAAAGCCATGGCATCTTTGGCAACCTTTGCTGCAGT
GCAGCCCACTACCAATGTCAAGGGCCTAGCTGGAAGCTCCATTACTGGAACTAAGCTTCATCTCAAATC
ATCTCGCCTCAATTTGAAGACCACTAAATCCAGGGCCGGCCCTGTGGTTGCCAAATATGGTGACAAGAG
TGTATACTTTGATTTGGAGGATTTGGGCAACACCACTGGCCAGTGGGACCTGTATGGATCAGATGCACC
TTCACCATACAACTCTCTTCAGAGCAAGTTCTTTGAGACATTTGCTGCTCCATTCACCAAGAGAGGTCT
TTTGCTCAAATTCTTGATATTGGGAGGTGGCTCCACCCTTGCTTACTTCAGTTCGACAGCATCAGGGGA
TATCCTACCAATCAAGAAAGGTCCACAACTTCCACCCAAGCTCGGCCCAC

SEQ ID NO:260 107760    (homologous to 25018)    460 bp

CTTTATCTTGATGCTGTTGAGTCCCACAAAGGACATTGTCATGTATGTGAACTCCCCAGGAGGGTCAGT
AACGGCAGGAATGGCCATATTTGATACCATGCGGCATATTCGACCTGATGTCTCCACTGTTTGTGTTGG
ACTCGCTGCAAGTATGGGAGCTTTTCTTCTCAGCGCGGGCACCAAAGGAAAGAGATATAGCTTGCCAAA
TTCAAGGATAATGATTCACCAGCCTCTTGGTGGTGCTCAAGGTGGCCAAACTGATATAGATATACAGGC
TAATGAGATGTTGCATCACAAAGCTAACCTGAATGGGTACCTTGCCTACCACACTGGTCAAAGCCTTGA
GAAGATTAACCAGGACACTGATCGTGATTTTTTCATGAGTGCAAAGGAAGCTAAAGAGTATGGGCTAAT
CGATGGTGTCATCTTGAATCCCATGAAAGCCCTTCAACCTCTTGCA

SEQ ID NO:261 107555    (homologous to 27402)    470 bp

TTGCCTCTCATGATAGGAATTGTTCTGCTTGTCCTGCAACAATTAGGAGGAACCAATGGTGTGATCTTC
TATTCCAGTAACATTTTCCTGTCTGCAGGGATTTCTTCAAGTAATGTTGCAACCTTTGGCGTTGGTGCT
ATCCAGGTTGTTGCCACTGCTGTTGCTACATGGCTGGTAGATAAATCTGGGCGTCGGATTTTACTGATT
ATCTCATCTGCTGGAATGGCTGTTAGTCTCCTTATTGTTGCTGCTGCATTCTTTCTGAAGGGCTTCGTA
GATAAGGATTCTACTCTTTATGACATGTTGGGAATATTATCGGTGGTTGGTGTTGTGTTGATGATTATT
GCATTCTCACTTGGAATGGGGCCCATTCCATGGCTTATAATGTCTGAGATCCTTCCGGTTAAGATCAAA
GGCCTTGCTGGAAGTGTAGCAACATTAGCCAATTGGTTCTGTTCCTGGGTAATTAC

Figure 5j

SEQ ID NO:262 107549 (homologous to 25414) 474 bp

AGCATGGCATCTTGGGCAACTCTTGCTGCAGTACAGCCCGCGAACTGCCGTCAATGGGCTAGCTGGAAG
CTCCATTATTGGAACTAAGCTACATGTTAAATCATCTCGCCTTAATTTGAAGTCTACTAAATCCAGGGC
TGGTTCTGTGGTAGCAAAGTATGGTGACAAGAGTGTATACTTTGATTTAGAGGACCTGGGAAACACCAC
TGGCCAATGGGACTTGTATGGTTCAGATGCACCTTCACCATACAACTCCCTTCAGAGCAAGTTTTTCGA
GACTTTTGCTGCTCCTTTCACTAAGAGAGGTCTGTTGCTCAAATTCCTGATATTGGGAGGTGGCTCAAC
TCTTGCATACTTCAGTTCAACTGCATCAGGGGATATACTACCAATCAAGAAAGGACCTCAACTTCCACC
CAAGCTTGGGCCACGCGGAAAGATCTAATTCCTTTTCAATCCAACTTTCTCAACCTTCAT

SEQ ID NO:263 107462 (homologous to 27410) 469 bp

CAAGAACATGATGTGTGCTGCTGATCCACGCCATGGTCGTTACCTCACTGCCTCAGCCATGTTCAGGGG
TAAAATGAGCACTAAGGAAGTCGATGAGCAGATGATTAATGTTCAGAACAAGAACTCTTCTTACTTTGT
TGAATGGATTCCAAACAATGTGAAATCCAGTGTCTGTGACATACCACCCAGAGGTCTCTCAATGGCATC
CACCTTCATTGGAAACTCAACTTCCATTCAGGAAATGTTTAGGAGGGTGAGCGAGCAGTTTACTGCTAT
GTTCAGGAGAAAGGCTTTCTTGCATTGGTACACAGGGGAAGGAATGGACGAAATGGAGTTCACAGAAGC
TGAGAGCAACATGAACGACCTTGTGTCCGAGTATCAGCAGTATCAGGATGCCACTGCTGATGACGAAGG
TGAATACGAGGAGGAGGAAGAGTACGATCATGAAGGCAACTGAAGAAATACATTT

SEQ ID NO:264 107410 (homologous to 25103) 484 bp

TCAAGTCTTCATAACGCAACTTTGGAGGACAAGAATCTTTCGCAGATCCCTCATTTCAGGCTGCTTCTG
AAACAATTAATTACCATGGAAGTTATTCAGTGGACATCTTTATGGAATACTTTCAAGGATGAGTTTGAA
AATGAAAAGAATATGCTTGGTGGATCTTTGGGTGACAAGGCAGCTGAAGATCTCAGACTGAGAGTTATA
GAGCATAACATTCTTGTTGTCTCAAAATACTACTCGAGGATAACTTTGAAGAGATTAGCAGATTTACTG
TGTCTTTCTATTCAGGACGCTGAAAAGCACCTTTCAGAAATGGTTGTATCAAAAGCACTTGTAGCAAAG
ATTGACAGATCTGTGGGTATAGTCTGTTTTCAACCTGCAAAAGACAGCAATGACATTTTAAATTCCTGG
GCTTTTAATTTGGAGAAGCTACTCGACCTTGTTGAGAAGAGTTGTCACCAAATCCACAAGGAAACTATG
G

SEQ ID NO:265 105377 (homologous to 34406) 477 bp

GGTATGCAAATCTTTGTTAAAACCCTAACCGGGAAAACAATAACCCTTGAAGTCGAAAGCTCTGACACA
ATTGACAATGTCAAGGCGAAGATTCAGGACAAGGAGGGAATCCCTCCAGACCAGCAAAGGTTGATTTTT
GCCGGAAAGCAACTCGAAGACGGCAGAACCCTAGCTGATTACAACATCCAGAAGGAATCGACCCTTCAC
TTGGTCCTTCGTCTTCGTGGTGGGATGCAGATCTTCGTCAAAACCTTAACTGGGAAAACAATCACCCTT
GAAGTCGAAAGCTCCGACACCATTGACAATGTCAAGGGTAAAATCCAGGATAAGGAGGGAATCCCACCA
GACCAGCAAAGGTTGATTTTTGCTGGTAAGCAATTGGAAGATGGCCGTACCCTAGCTGATTACAACATT
CAAAAGGAGTCGACTTTGCACCTTGTGCTCCGTCTTCGTGGTGGGATGCAGATTTTCGTGAAG

SEQ ID NO:266 105321 (homologous to 25016 ) 494 bp

GCTTTCTCTTCTCCAATTTCTTTAGTTTAATTTTGAAAATGGGAGTCATATCTACCAACAAAAATGGCT
CTAATATCTTCAAGAATGGTGCCATTCCCATGAACGGCTACAAGAATGGCACTTCCAAACACCAAAACG
GCCACCAGAATGGCACTTCCGAACATCGGACTGGCCACCAGAATGGAATTTCCGAACACCAAAACGACC
ACCAGAATGGCACTTCCGAACATCAAAACGACCATCATAATGGGAGATCCGAACAACAGAACGGGACAA
TCAGCCATGACAATGGCAACGAGCTACAGCTACTGGGAAGCTCCAACTCTATTAAGCCTGGTTGGTTTT
CAGAGTTTAGCGCATTATGGCCAGGTGAAGCATTCTCACTTAAGATTGAGAAGTTACTATTCAAGGGGA
AATCTCACTACCAAGATGTCATGCTCTTTGAGTCAGCAACATATGGGAAGGTTCTGACTTTGGATGGAG
CAATTCAACAC

Figure 5k

SEQ ID NO:267  103721  (homologous to 30087 )  442
bp
TGGTATGAACGCAGAGTGGCCATTACGGCCGGGAAGGATAAAGGCTGGTGTTTACAGAGAGAATGTAGA
TGTGCCGAAGAAGAAGACGAACATAATGTTCATGGGAGATGGAAGAAGCAATACTATTATTACAGGAAG
TAGGAACGTGAAAGATGGTAGCACTACCTTCAATTCCGCCACTGTTGCGGCGGTAGGTGAAAAATTCTT
GGCCCGAGACATAACATTCCAAAACACAGCAGGGGCTGAAAAACACCAAGCTGTAGCACTTCGCGTGGG
CTCTGATTTGTCCGCTTTCTATAGATGTGACATTTTAGCCTATCAAGATTCTCTCTACGTTCACTCCAA
TCGCCAATACTTTGTTCAGTGTTTAATTGCTGGCACTGTTGATTTTATTTTTGGCAATGCTGCTGCTGT
TTTACAAGACTGTGATATTCATGCCCGA SEQ ID NO:268  53472  (homologous to 45855)  499
bp
TTCTGAAGTTCCATTAATATTATCTCAAGAAGAAAAATGGGTTACTTCGTCTAAAGATAAAATCAAAAC
CAACAGAGAGTTTAGAACAAAAGTGAATAGATAAACTACAGCTCCTGAGAAATGATAATGGCGATTCCT
TCCGATACTTCTTGAAATCTATCCTCCTCATATGTTGCTAGGGTACATGAAGACTCTGACTCTAGCTCC
CATTGACTTGGGTGGTAGGTTTGAAGTGAACTTAGAACGGACAACACCGCTGTTACCATGAGGCCTAGT
GACTTTGCCCCAAATGCAACGGTAGTGAGAACCGTTCTTCTTTGTCTTTGCCTTGTAGATGTAAGCCAA
ACGCTTACCCTTGTACCAATTGACCTCCTCTTGAGTGTTCACACCTTCAATCTGGATGAGAGAAGTGTT
GGGATATTGGTTCGACTTGGACCTCTTGTAGCCGAGGACTGTTCCACGAACATACAATCTAACTCTCTC
TCCTTGACGTCCCTTC SEQ ID NO:269  27489  (homologous to 27414)  466
bp
CCCACGCGTCCGGCTAGTGGGAGAATCCGGTTGCATCCCGGAGATCGTGAAACTTCTGGAATCGAAGTC
AAACGGATGTCGAGAAGCGGCGGCTCAGGCGATCGCTGGATTGGTAGCGGAAGGAAGGATTCGACGGGA
ACTGAAGAAAGACGGGAAGAGCGTTCTGACGAATTTGGTGATGTTATTGGATTCAAACCCTGGAAACAC
GGCGAAGAAGTACGCCGTGGCGGGGCTGTTGGGGATGTCGGGAAGCGAGAAGAGTAAGAAAATGATGGT
GTCGTACGGAGCAATAGGGTATCTGAAGAAGCTGTCGGAGATGGAAGTAATGGGCGCCGATAAGCTTCT
CGAGAAGCTTGAAAGAGGAAAGCTAAGAAGCTTCTTTCACCGGTAAAACGAACGATGCGGAGACATTGA
AGCAGCCAAGATAAAAGTGTAATATTGTCTGATGTAAGTTTATTAACCGTT SEQ ID NO:270  26868  (homologous to 45891)  464
bp
CCCACGCGTCCGGAGAAGAATCAGAGAAAATGCCGCCGAAGTTGGATCCATCTCAAATCGTCGACGTCT
ACGTCCGAGTCACCGGAGGTGAGGTCGGAGCAGCGTCTTCACTCGCTCCAAAGATCGGTCCACTCGGTC
TGGCACCAAAGAAGATCGGAGAAGACATCGCCAAAGAGACAGCGAAAGAATGGAAAGGTCTTCGAGTCA
CCGTGAAGCTTACGGTACAGAATCGTCAAGCTAAGGTCACAGTGGTTCCATCCGCAGCGGCTCTAGTCA
TCAAAGCCCTCAAGGAGCCAGAGAGAGATAGGAAGAAAGTGAAGAACATCAAACATAATGGCAACATTT
CGTTTGATGATGTGATTGAGATTGCTAAGATAATGCGTCCTAGATCTATCGCTAAGGAATTGAGTGGAA
CAGTGAAGGAGATTTTAGGAACTTGTGTCTCTTTTGGTTGCACTGTTGAT SEQ ID NO:271  25442  (homologous to 25437)  136
bp
AGATACATTACCAGATTGAAGTCTGTATTTTTCTTCTCTTTGTGTGTAAATATGAAACGAAGGCGGTCA
GATTATATATAAGCTTCTTCTTTCTTCCGTTCTTATGAAGTTTTATGCAATCATAGAAGCTTCTTGT

Figure 5k

SEQ ID NO:272 25439  (homologous to 25450)  471 bp
CCCACGCGTCCGCAAACATCAGAAGCCCTAGAGCTTGAGCCGGGGAAAATGTCGAAGCGAGGACGTGGA
GGAACGTCTGGTAACAAATTCAGGATGTCACTTGGTCTGCCCGTTGCAGCCACAGTGAACTGTGCAGAC
AACACTGGTGCTAAGAACCTTTACATCATCTCTGTTAAAGGAATCAAAGGTCGTCTCAATCGGTTACCT
TCTGCTTGTGTTGGTGACATGGTTATGGCCACTGTCAAGAAAGGTAAACCAGACCTCAGGAAAAAGGTT
CTTCCTGCTGTGATTGTTAGGCAACGTAAGCCATGGCGCCGAAAGGACGGTGTTTTCATGTACTTTGAA
GATAATGCTGGAGTGATTGTGAACCCTAAGGGAGAAATGAAAGGTTCTGCAATTACTGGACCTATTGGG
AAAGAGTGTGCGGATCTCTGGCCAAGGATTGCTAGTGCTGCTAACGCCATTGTCTGA

SEQ ID NO:273 25152  (homologous to 25123)  468 bp
CCCACGCGTCCGGTACAATGTCTCCTATGTCTACCATGCCCTAGATGCCTACATCGAGAGAGACAATGT
CGGCTTGAAAGGTTTCACCAAGTCAGTTTCTTTAGTCTAAAGGAAAACCGTATTTGTGTCTCTTCAGCT
GGTGGATCATCTTTTTGTTATTGTTGAGGGTTTAACGCTAATAGGTTCTTTAACGATTCAAGTCTTGAA
GAACGAGGTTATGCTGAGAAGTTTATGGAGTATCAGATGCATTGTTTGCGATGGAGCTTGCACTGACTT
TGGAGAAACTTATTAATGAAAAGCTTCTGAAGTTACAAAGTGTTGGTGTGAAGAACAATGATGTTAAGC
TGGTTGATTTTGTAGAATCTGAGTTTCTAGGCGAGCTGGTCGAAGCCATCAAGAAAATCTCAGAGTACA
TAGATGGAACAAAAATAAGGTCAATGCAGTGGTGAAGCTGAGATCGGATGTTTC

SEQ ID NO:274 25008  (homologous to 25004)  452 bp
TGACTGATTACTACTACTTGTACTAACTCTAGTACATTTACAAAACAAGTCCTCCTTTTCCCCAAGTAT
ACAGATAAAGATTTACCAGAACCGGTTTTCCGCCTTCATCTCACATGGAAATCGTAAGGAGAAGACGCA
TACACTTGATCTGGAACCACTAGTGGTAACTTCTCAATGTACATAAACAATCGTTTCTGGTTCTCTCTA
GCGATTGCAGTGAGATTCACTGTATCGTTTTGGTCCAAAAACATCCAGAGATCACCTGAATCTACTCTT
TTAAGGCTGTCTCTGCAGGAGTTAAGCAGATTGTTTTGGTTGGGTCGATGGGAGGAACAAACATTAATC
ACCCTCTCAATAGTATTGGCAATGCTAACATTCTGGTCTGGAAGAGAAAGGCTGAGCAATACTTGGCTG
ATTCCGGTATTCCATACACCATCATCAGGGCTGGAGGT

SEQ ID NO:275 23612  (homologous to 23869)  382 bp
TTTCCTTCTCTCACCGCGAGAGTGACCGAGAGACATGATTCTGATAAACTCTAATTCTCCGACGCTAAT
CTCAGCCGCTAGATTCGTGGGCTCATCTCCGTTCACCACTCGGGGGCTTTCTCAGTCCACTGTCTCAAT
CTCTAGAAACAAAAGCTTCTTCTTCCACTTCACCGAGACGAAGGAGAAGAACGCAAGAAGAGATTATTT
GAGAGTATCAATCGTGTGTGACGCAGGAGGGATGTTTCCGGTGGATCCATGGGCTCCAACCATTGATTC
ACAGAGCATAGCATCACAACTCTTCGCTGTATCTCTGTTTCCTTACATTGGCTTTCTCTATTTCCTCAC
TAAATCCAAATCAGCTCCAAAACTCACACTTTTCGGG

SEQ ID NO:276 21693  (homologous to 45784 )  482 bp
AATCTGCACTTACTTGGCCCGACTTGACTGGACGACCCACGCGTACAGGCTCGGCTATGGTCCAATTCT
CTCCCTTCTCTCTCTTCTCTTTCTTCTTCTTCCTCGCGCCTTCTTCAATCTCCGACTTTCGCTTCT
CCAGTTCTGAGCCTTAAACCCAACGCTGTCCAGTCCAAGAACAGAGTCTCTCTCAGTGCTTACAGCTTG
AACTCTAGCCATGGAACAATTGTGGTGAAGGCGGCTGCTTCTGGCGTGGACGGGCTGAGCCTGAGAGC
AATGAAGAACCAAAGACTGTTGCTGCTGCTGTTCCAGTGGATAAACTACCGATGGAATCGAAAGAAGCT
AAAGAGAAACTGCTCTTGGAATAGAGGCTGAAGATGAAGCTGGCCAAAAAGATTAGGCTACGCAGGAAA
CGTCTGGTTCGTAAGCGTAAGATGAGGAAGAAGGGTCGATGGCCACCTTCCAAGATGAAGAAAAACAA

Figure 51

SEQ ID NO:277 7813 (homologous to 25979 )                                    472
bp
CCCACGCGTCCGAAAAGGGGAAACCTCTGCATCAATGGCGATTTCCAAACTCCATCTACTCTGTCTTCT
CTCAGTCTTTCTCTCCCTTCATCGTCTTGTTCTTTCCGGCACCGATGGAGAAGAAGACCTTCTTCTTAC
AGTATTCAACAAATACAGAACAGGACTAAACCTAAAAACCTTAACAAAGAACGAAAACGCAGAATGTCT
CGCAGACGAAGTCGTAGACCAACTAAAGAACCAACCCTGCACAAACACTAATAACTCAGCTCCAGTCCC
TGGAAATAACCTCCTCGCTAAATGCAGTCTCAACACAACCGTAGTCAGAGACGGTGTGATCATGCAAGT
CTGTTTTCCTAAGCATGATAAGAACCCTGACTTGAGCAATTTCAACAGTGTCGTACTCAAGAACTTGAA
TGATTCTAAGATCACTGGAATTGGTATTGGTTCTGGTGATATTTGGGTTGTTGTCATC SEQ ID NO:278 4690 (homologous to 45806)                                     487
bp
GCTCGAGAATTGCGGCCGCAAAATCCGAAAAGGAGTGACATAACATTACAACATTAGGAATAAAGTGGA
TAAAACATTGATCAAAGGAAATTTAGTTATAGTTGAAAATTTTTATTATAAAAAGGGAACGAAGGGAGA
TTTTTTCAAGGGCATTTTGGTCCACCCTCTTGAGTTTTCCAGTTGTTGTAGCAGGAGCAAACTTGTTTG
TTCCCATAGTAACCCGGAGGCACACAGAGACACTTCCTGCAGCATTTGTTGCAGAACGTAATGCAAGCC
TTGTGGTACTGTGTCTTTTTACACCTCCTATCACATTCCGATGGGCATTGGGTACGTTTCAGGCTTCCT
GGTCCATAACGTTTCTGGCTCCACTTCACATTAGATCCACTTGAGGCCATAACCATGGTTTGAAGCATG
AAGAGGACAATGAGGGTCAAGAGGAAGATAGCTCCATATGACTTAGCCATTTTCAGTTTGGGATATTGT
TATC Figure 6a
DNAs that Cause a Dwarf Phenotype

| SEQ ID NO. | Source | Sense or Anti-sense |
|---|---|---|
| 1 | Nicotiana benthamiana | A |
| 2 | Nicotiana benthamiana | A |
| 3 | Arabidopsis thaliana | S |
| 4 | Arabidopsis thaliana | S |
| 150 | Arabidopsis thaliana | S |
| 5 | Arabidopsis thaliana | S |
| 151 | Arabidopsis thaliana | S |
| 6 | Arabidopsis thaliana | A |
| 7 | Arabidopsis thaliana | A |
| 8 | Arabidopsis thaliana | A |
| 9 | Arabidopsis thaliana | A |
| 10 | Arabidopsis thaliana | A |
| 11 | Arabidopsis thaliana | A |
| 12 | Arabidopsis thaliana | A |
| 13 | Arabidopsis thaliana | A |
| 14 | Arabidopsis thaliana | A |
| 15 | Arabidopsis thaliana | A |
| 16 | Arabidopsis thaliana | A |
| 17 | Arabidopsis thaliana | A |
| 18 | Arabidopsis thaliana | A |
| 19 | Arabidopsis thaliana | A |
| 20 | Arabidopsis thaliana | A |
| 21 | Arabidopsis thaliana | A |
| 22 | Arabidopsis thaliana | A |
| 23 | Arabidopsis thaliana | A |
| 24 | Arabidopsis thaliana | A |
| 25 | Arabidopsis thaliana | A |
| 26 | Arabidopsis thaliana | A |
| 27 | Arabidopsis thaliana | A |
| 28 | Arabidopsis thaliana | A |
| 29 | Arabidopsis thaliana | A |
| 30 | Arabidopsis thaliana | A |
| 31 | Arabidopsis thaliana | A |
| 32 | Arabidopsis thaliana | A |
| 33 | Arabidopsis thaliana | A |
| 34 | Arabidopsis thaliana | A |
| 35 | Arabidopsis thaliana | A |
| 36 | Arabidopsis thaliana | A |
| 37 | Arabidopsis thaliana | A |
| 38 | Arabidopsis thaliana | A |

FIGURE 6B

| SEQ ID NO. | Source | Sense or Anti-sense |
|---|---|---|
| 39 | Arabidopsis thaliana | A |
| 40 | Arabidopsis thaliana | A |
| 41 | Arabidopsis thaliana | A |
| 42 | Arabidopsis thaliana | A |
| 154 | Arabidopsis thaliana | A |
| 43 | Arabidopsis thaliana | A |
| 44 | Arabidopsis thaliana | A |
| 45 | Arabidopsis thaliana | A |
| 152 | Arabidopsis thaliana | A |
| 46 | Arabidopsis thaliana | A |
| 47 | Arabidopsis thaliana | A |
| 48 | Arabidopsis thaliana | A |
| 49 | Arabidopsis thaliana | A |
| 50 | Arabidopsis thaliana | A |
| 51 | Arabidopsis thaliana | A |
| 52 | Arabidopsis thaliana | A |
| 53 | Arabidopsis thaliana | A |
| 54 | Arabidopsis thaliana | A |
| 55 | Arabidopsis thaliana | A |
| 56 | Arabidopsis thaliana | A |
| 57 | Arabidopsis thaliana | A |
| 58 | Arabidopsis thaliana | A |
| 59 | Arabidopsis thaliana | A |
| 60 | Arabidopsis thaliana | A |
| 61 | Arabidopsis thaliana | A |
| 62 | Arabidopsis thaliana | A |
| 63 | Arabidopsis thaliana | A |
| 64 | Arabidopsis thaliana | A |
| 153 | Arabidopsis thaliana | A |
| 65 | Arabidopsis thaliana | A |
| 66 | Arabidopsis thaliana | A |
| 67 | Arabidopsis thaliana | A |
| 68 | Arabidopsis thaliana | A |
| 69 | Arabidopsis thaliana | A |
| 70 | Arabidopsis thaliana | A |
| 71 | Arabidopsis thaliana | A |
| 72 | Arabidopsis thaliana | A |
| 73 | Arabidopsis thaliana | A |
| 74 | Arabidopsis thaliana | A |
| 75 | Arabidopsis thaliana | A |
| 76 | Arabidopsis thaliana | A |
| 77 | Arabidopsis thaliana | A |
| 78 | Arabidopsis thaliana | A |

FIGURE 6C

| SEQ ID NO. | Source | Sense or Anti-sense |
|---|---|---|
| 79 | Arabidopsis thaliana | A |
| 80 | Arabidopsis thaliana | A |
| 81 | Nicotiana benthamiana | A |
| 82 | Arabidopsis thaliana | A |
| - | Arabidopsis thaliana | A |
| 84 | Arabidopsis thaliana | A |
| 85 | Arabidopsis thaliana | A |
| 86 | Arabidopsis thaliana | A |
| 88 | Arabidopsis thaliana | A |
| 89 | Arabidopsis thaliana | A |
| 90 | Arabidopsis thaliana | A |
| 91 | Arabidopsis thaliana | A |
| 92 | Arabidopsis thaliana | A |
| 93 | Arabidopsis thaliana | A |
| 95 | Arabidopsis thaliana | A |
| 96 | Arabidopsis thaliana | A |
| 97 | Arabidopsis thaliana | A |
| 98 | Arabidopsis thaliana | A |
| 99 | Arabidopsis thaliana | S |
| 100 | Arabidopsis thaliana | A |
| 101 | Nicotiana benthamiana | A |
| 102 | Arabidopsis thaliana | n.d. |
| 103 | Arabidopsis thaliana | n.d. |
| 104 | Arabidopsis thaliana | n.d. |
| 105 | Arabidopsis thaliana | n.d. |
| 106 | Arabidopsis thaliana | n.d. |
| 107 | Arabidopsis thaliana | n.d. |
| 108 | Arabidopsis thaliana | n.d. |
| 109 | Arabidopsis thaliana | n.d. |
| 110 | Arabidopsis thaliana | n.d. |
| 111 | Arabidopsis thaliana | n.d. |
| 112 | Arabidopsis thaliana | n.d. |
| 113 | Arabidopsis thaliana | n.d. |
| 114 | Arabidopsis thaliana | n.d. |
| 115 | Arabidopsis thaliana | n.d. |
| 116 | Arabidopsis thaliana | n.d. |
| 117 | Arabidopsis thaliana | n.d. |
| 118 | Arabidopsis thaliana | A |
| 119 | Arabidopsis thaliana | A |
| 120 | Nicotiana benthamiana | A |
| 121 | Nicotiana benthamiana | A |
| 122 | Nicotiana benthamiana | A |
| 123 | Nicotiana benthamiana | A |

FIGURE 6D

| SEQ ID NO. | Source | Sense or Anti-sense |
|---|---|---|
| 124 | Nicotiana benthamiana | A |
| 125 | Nicotiana benthamiana | A |
| 126 | Nicotiana benthamiana | A |
| 127 | Nicotiana benthamiana | S |
| 128 | Oryza japonica | S |
| 138 | Oryza japonica | S |
| 139 | Oryza japonica | S |
| 129 | Nicotiana benthamiana | S |
| 140 | Papaver rhoeas | S |
| 141 | Papaver rhoeas | S |
| 142 | Papaver rhoeas | S |
| 143 | Papaver rhoeas | S |
| 144 | Papaver rhoeas | S |
| 145 | Papaver rhoeas | S |
| 130 | Oryza indica | S |
| 131 | Oryza japonica | S |
| 132 | Oryza japonica | A |
| 146 | Papaver rhoeas | S |
| 147 | Papaver rhoeas | S |
| 148 | Papaver rhoeas | S |
| 133 | Oryza indica | S |
| 134 | Oryza indica | S |
| 149 | Oryza japonica | S |
| 135 | Papaver rhoeas | S |
| 136 | Oryza japonica | S |
| 137 | Oryza japonica | S |

FIGURE 7a

SEQ ID NO:280 182206 Poppy
TCCATCTCAGTTCGTGTTCTTGTCATTAATTAAGTCGACGAATTCGAGAAGGCTCTTCCTACCTACACT
CCAGAGATCCCAGCTGATGCCACCAGAAACCTATCCCAGACATGCCTTAATGCACTTGCTCCAGTCCTC
CCTGGTCTTATTGGTGGTAGTGCAGATCTCGCTTCCTCCAACATGACCTTGATGAAAATGTTCGGAGAT
TTCCAAAAGGCCACTCCAGAAGAGAGGAATGTTCGATTTGGTGTCAGAGAGCATGCTATGGGAGCCATC
TGTAACGGAATTGCTCTCCACAGTCCTGGTTTTGTCCCCTACTGTGCTACCTTCTTTGTTTTCACCGAT
TACATGAGAGGTGCCATGAGAATTTCAGCCTTATCTGAAGCTGGAGTCATTTACGTCATGACCCACGAC
TCTATTGGTCTTGGAGAGGATGGTCCAACTCATCAGCCCATCGAACATTTGGCAAGCTTTAGAGCCATG
CCTAACATTCTTATGTTCCGTCCCGCTGACGGAAACGAGACTGCCGGGGCATACAAGGTTGCAGTTGAA
AACAGAAAGAGACCCTCAATTCTTGCCCTTTCACGTCAAAAGCTTGCAAACCTTCCAGGAACCTCCATT
GAAGGAGTCGCCAAGGGAGGTTACACAATATCAGACAACTCTACAGGTAACAAACCAGATGTCATCGTG
TGTGCTACTGGTTCAGAATTAGAAATTGCTGAAAAGGCCGCTGGTGAGCTCAGGAAGGAAGGAACTGCA
GTTAGGGTTGTTTCATTTGTTTCCTGGGAATTATATGATGAACAGACCGACGAATACAAGGAGTCTGTT
CTTCCAGCTGCTGTCACTGCTAGAGTTAGTATTGAGGCAGGTTCAACATTCGGATGGACAAGATTATC
GGAAGCAAAGGAAAGGCTATTGGTGTTGACGGTTTCGGAGCAAGTGCGCCTGCACCAATTATATACAAA
GAGTTTGGCATCACATCAGAGGCCGTTATTGCAGCAGCTAAGTCAGTTATGTAGATTGTTTTCTTTGTC
CCTTTTTCAGCTGAAGCTTATTTGTCATTTTGGTTTTTGGATTTCTGCTCTTCCAAATTTAGAAGTGAC
ACGGGAGGAGAGAGGCCTGTCTTTAAGAGTAATTTGAGTTCAGAAAAACAGCCTCGTGAACGAATTATA
ATAATAGATTAAAAAAAAGAACAAAAAAAAAAAAAAAAAAAAAAAAAAAAAACTCGAGCGGCCG SEQ ID NO:281 21604 Arabidopsis thaliana
GAAGCACGAACGGCGTCGGGTTAGTCCGACGGAGGAACCATGTCCTCGTCTCTTCTTCTCTCCGGTTCT
ACTGTATCTTCTTCGTTTATCGCTCCATCTAAGCCTTCTCTCGTACGAAATTCCAGTAAGACATCACTG
TTACCATTTCGTAATGTTTCGAGAAGCTTCAAAACCGTCAAGTGCACCGTTGATTCTTCATATGGAGGC
AATGTTCCCACGTTCCCTCGGACGAGAGTTTGGGACCCGTACAAACGTCTAGGAGTTAGTCCATATGCT
TCCGAGGAAGAAATCTGGGCCTCTCGTAACTTTCTTTTACAGCAGTACGCTGGACATGAAAGAAGCGAA
GAGTCTATAGAAGGAGCCTTTGAGAAGCTTCTCATGTCTAGTTTTATCAGAAGGAAGAAGACTAAAATC
AATCTTAAATCAAAGTTGAAGAAGAAAGTTGAGGAATCTCCTCCGTGGCTCAAAGCTCTTCTCGATTTC
GTTGAAATGCCTCCCATGGACACTATTTTCAGAAGACTTTTCCTCTTTGCCTTCATGGGTGGTTGGAGT
ATCATGAACTCTGCAGAAGGCGGTCCTGCGTTTCAGGTGGCGGTATCATTGGCTGCGTGCGTATATTTT
CTGAATGAGAAGACAAAGAGCTTGGGGAGAGCTTGCTTAATCGGAATTGGAGCTTTAGTTGCCGGGTGG
TTCTGCGGTTCGTTAATCATTCCCATGATTCCGACGTTTCTCATTCAGCCTACATGGACACTCGAGCTC
CTAACATCACTGGTCGCTTATGTGTTTTTGTTTCTTTCTTGTACTTTCCTCAAGTAAGTTACGTTGTGG
TTTTATCCAAACTCTTTTTGTTCTTTTCGCCCAGACATTTACAGAACCTTTCGGAAAAATTAGTGAAAG
TTGTT SEQ ID NO:282 23242 Arabidopsis thaliana
TTCGTTTTAAATAGATCTTACAGTATCACTACTCCATCTCAGTTCGTGTTCTTGTCATTAATTAACTGC
AGGTACCGGTCCGGAATTCCCGGGTCGACCCACGCGTCCGCTCAATGGAGTACAAACATTTCAGCCATC
CACACACTCTAAAACTCCAACAGATTCAGCCACATAAAAGCTCAGATTCTTCAGTAATCTGCTCAGGTT
GTGAATCAGCCATCTCTGAATCCGAAACCGCGTATATCTGTTCAACATGTGACTTCAATCTTCATGAGC
AATGTGGTAACGCAGTGCGTGGGATGCAACATCCTTCTCACGCTGGTCTCCACCACTTGACTCTAGTCC
CTTACACAACTTACAGCGCTGGTACCTTCCTCTGCAGAGCCTGTGGCTGCACTGGAGGTAAAGGGTTCT
CTTACTGTTGTCCTTTGTGTGACTTTGACCTTCATGTTCAATGCGCTCACCTGCCTCAGGTCTTGGTTC
ATGAGTCTCATCCTATGCATAGTCTTCTTCTTGTCTACAACAGTACTCCTCCTATGTCTTTTACTCAGT
TTGGTTTCGGGAATCAGCTTGTTTGCAATCTTTGTAATATGACTATGGATGGTAGGTTTTGGTCTTACA
ACTGTTATGCTTGTAACTATCATATTCATGCTTCATGTGCTGTGAATAAGCCCAATCCAGTGGCTGCTT
CTGCTGAGAACTGTGGGCGAGTGATGAAGGAAAGACACCGACTGCTGAATCTGTTCCTGTTCAGGGTT
TGGAGACTGAGCAGACGGAACAAGTAGCTGCAATAACAGAGCAAGTGGAAGATCCAGTTTTGAGGCAAC
AGCTTGAGCTTCAGAAGCTTCAGCTTGAGCTAGATATGAGTTCTGCTCTCGCAAACATGATTGGTTCCT
TCAATCTCAGTTCTTTCGTTTGAAGTGTCTTTGTGTTTCAGTTTGTTTGATTTTATGCATTTACATGTG
TTGAATTGTCTCTGTTCTTGTGTTCCCTAATGTGCTTCTGATTTGAATAAATATATCCTATCTATTTGG
TTTAAAAAAAAAAAAAAAAAAAAGGGCGGCCG FIGURE 7b SEQ ID NO:283 23869 Arabidopsis thaliana
AGTTCGTGTTCTTGTCATTAATTAACTGCAGGTACCGGTCCGGAATTCCCGGGTCGACCCACGCGTCCG
CTCTTTCCTTCTCTCACCGCGAGAGTAACCGAGAGACATGATTCTGATAAACTCTAATTCTCCGACGCT
AATCTCAGCCGTTAGATTCGTGGGCTCATCTCCGTTCACCACTCGGGGGCTTTCTCAGTCCACTGTCTC
AATCTCTAGAAACAAAAGCTTCTTCTTCCACTTCACCGAGACGAAGGAGAAGAACGCAAGAAGAGATTA
TTTGAGAGTATCAATCGTGTGTGACGCAGGAGGGATGTTTCCGGTGGATCCATGGGCTCCAACCATTGA
TTCACAGAGCATAGCATCACAACTCTTCGCTGTATCTCTGTTTCCTTACATTGGCTTTCTCTATTTCCT
CACTAAATCCAAATCAGCTCCAAAACTCACACTTTTCGGTTTCTACTTCTTGCTTGCCTTCGTTGGAGC
TACAATTCCAGCTGGGATTTATGCTAAGGTGCATTATGGAACATCGTTGTCAATGTTGATTGGTTACA
CGGAGGAGCTGAATCACTTCTTGCTCTTACCAATTTGTTTATCGTGTTGGGTCTTAGACAAGCTCTGAG
GAAGTCTCAAGATGATGATGATGATAAACTTGGTAATGATGATGAAGTTCCAACAACTCAAGAACAAGG
GAAATCTTCAGTGTAGTAAAACAAATGTAAATTTTTTAATTATGGAGTTTCACTTGTTTTTTAATTAGA
TTATATATAGTCGACGCCCATCTAATTCCCATTTTAGAAAAAAAAAAAAAAAGGGCGGCCGCTCGAGGGG
TAGTCAAGATGCATAATAAATAACGG SEQ ID NO:284 25004 Arabidopsis thaliana
TGACTGATTACTACTACTTGTACTAACTCTAATACATTTACAAAACAAGTCCTCCTTTTCCCCAAGTAT
ACAGATAAAGATTTACCAGAACCGGTTTTCCGCCTTCATCTCACATGGAAATCGTAAGGAGAAGACGCA
TACACTTGATCTGGAACCACTAGTGGTAACTTCTCAATGTACATAAACAATCGTTTCTGGTTCTCTCTA
GCGATTGCAGTGAGATTCACTGTATCGTTTTGGTCCAAAAACATCCAGAGATCACCTGAATCTACTCTT
TTAAGGCTGTCT SEQ ID NO:285 25008 Arabidopsis thaliana
TGACTGATTACTACTACTTGTACTAACTCTAATACATTTACAAAACAAGTCCTCCTTTTCCCCAAGTAT
ACAGATAAAGATTTACCAGAACCGGTTTTCCGCCTTCATCTCACATGGAAATCGTAAGGAGAAGACGCA
TACACTTGATCTGGAACCACTAGTGGTAACTTCTCAATGTACATAAACAATCGTTTCTGGTTCTCTCTA
GCGATTGCAGTGAGATTCACTGTATCGTTTTGGTCCAAAAACATCCAGAGATCACCTGAATCTACTCTT
TTAAGGCTGTCTCTGCAGGAGTTAAGCAGATTGTTTTGGTTGGGTCGATGGGAGGAACAAACATTAATC
ACCCTCTCAATAGTATTGGCAATGCTAACATTCTGGTCTGGAAGAGAAAGGCTGAGCAATACTTGGCTG
ATTCCGGTATTCCATACACCATCATCAGGGCTGGAGGT SEQ ID NO:286 25009 Arabidopsis thaliana
CACTTAAAACACTGATTTATTCTCTTTCCCTCTTCTTATTTCAACGGCCTATGTGGAAAGTTTTTGATT
GAGAATCCAAATCACACATTACATCAAATCAGAACTCATTATGAGTCACTAACGAGTTCAGACATGTCG
CGGCTGATGCTGTTCTCATGTGTGGACAATGGAGTTCCAGATATAAAAGCCTTGAAGAGCGCAAGAGCT
TGCTTCGGTCTGTGCAAAGGAACTTCATGGCCTGCACCTCTCACTGTCACAAAGTTCAGACCAGCATAC
TGCTGACTCCACCCTCCCACCTGTCCATCTAAGTACCAAGGACCATAGGCACTCAAAGGACGAAGGTTT
AGTGCATCGATACTGTACCGGGTTGATGTGACTGGTACAACGGCATCTGCGTCCCCACTGAAAACCCAG
ATACGAAGCCCAGCAGCTATAAGCTCGTGGTAAATGTTTAGAACCGAGGAAGGAGAGTCATTCCAGTGT
TCACTCACGACATCACTGCAAGTATCCCATTTTGATGGTGCAAGTCCTGGTGGGACATGGAGGGCTTTT
CGgacgcgtGGG SEQ ID NO:287 25011 Arabidopsis thaliana
TTTTGAATGAATAAAAGTCTTATAATTATGATGTGTGTACAACTACAAAGTTTTCCTTGGAGTATAGTT
TGAGGATTTATCCAGAAGTAGCAGAAGAAGCAGCTACAGACTCGGAGAGTTCTTCCATGAGTTCCTTTT
GCTCCAAAGCAGCACAAGCCTGCACTGCGTCCTCTAAAGCACCGTCAAGAAATGTTGTAAGCGCAAAGT
TCATCTTTAGCCTATGATCAGTCACTCTACTGTCCTTATAATTGTATGTTCTTATCTTTTCTGAACGAG
CTCCAGTCCCAACCTGAGATTTCCTTTCATTCCTTATCTTCTCTTGTTGTTCCCTTACTTTTATTTCAT
ACAGTTTTGCTCGCAGAAGCTGGAAAGCACGCGCCTTATTCCTAATCGGACGCGTGGG SEQ ID NO:288 25015 Arabidopsis thaliana
ACATTAACAACGGGTTTTATAGATTTAATCAAATATGATCCTTACAAACCACACTGAGAATAGTTATAC
GACATAGATACAGTTGCTGGTTAAATAGCAAACTCAGTTACGGCATATCTTGGCGGTAGGCATTGTGAC
ACAGACTGGAGCATACTTCTTCTTGGCAGCTTCTGTTCCTCTCTTTGGCTCATCGTCTGCCATTGCCAC
CTTAGCTAAGGAGCACACAGCTGCAG FIGURE 7c SEQ ID NO:289 25026 Arabidopsis thaliana
AAAGAGTACAACAATGTTGATTAACTTAGTTCCTCTGTACATTGAAGATTCCAAATTTGTTCATGGAGC
TACAACGGTTCAACAATAATTCAAGCTCAAAAACCAAGAACTCTAAGATGAAACACACTCACAGACAGA
CATGAAAGTGATGGAAGATAGATAGGTATGAGATCATAAGTCTGTCTTCACTCTTTAGTTGAAGGTTTG
GACAATAGTGTTGTGCCATGGGTCAGACAAGTGCTGC SEQ ID NO:290 25062 Arabidopsis thaliana
TATGTGAGAGATATAGTAACTACAACTGAATGAAAAATCCATGAGACAAAAAAGTTCGCAATAGAAGAA
TATTGATTCGGTAACAAAGCACAGCTTATAAGTTTTCTTGTGTTAAAGATGAACCAATTTGAAGCATTA
GAGGATAAACTGGACTAAACTCTTTGTCCCCTCTCGATCTGATCTTCACTGCATAATCATCCAAAGTTG
CTTTTATCCCTTTCCAGATCTGATCCTCTCTTTGGTTATCAAGCACAGTGAGTACTGTTTAGGACTTA
GTCTGTTCTTCTGCATCGGTGACTCTAACTCGTCTGGGCCTCTTGTGTAGAGATGATGTAGGACGATGC
TCGGTGGTAGATCATTGATGAGAGGAGATGATCCCATTTGAGATGTTTCCAGGAAAACCAAAGGCCTAA
ACGCTCTAAGAGCTCTGTACGGTGCTCCGAGTTGTTCCACGGGAAATAGATTCTGTCCCACTGCTAGTT
CCAGCTCGGCCATGTCTTTGGCCATTCTGAGTTTTCCCCATTCTGAAAGTGGTCGCACAAGGGATGCAT
GTCTGATGTAGAAGATCAAAACCCTTGACGCCATTTGTCTTGTGAGTCTTGTGCAGATCGATTCTGTT SEQ ID NO:291 25104 Arabidopsis thaliana
TTTTGAAACATAAACAAAACTCTTATTTATTAAGGACTTGTGCTAAATACATTTAGCCTCAAACATCCA
AAACTTACATTTTCATAAAAGACACGATGAGGTGTGGTGTTAACATGTATCAACAACCACACTCTCATA
CGCTCGAGGGTTTTTGTTTGGAATCTATTAGTAAGGAGGGAAGAAAGGGATGGTGGTCTGGAAGGGGCA
TTCACCAACTTGCTGGATCTTGCAAATGTTAGGCAAGTACTTAGCTGTCTTGTAAATTTTCCTGGATTG
GAATGGTCCGTGTTGTCCCTGGAGGCTAACGGCCCTGGCAGCTTGTCTCAAGGTGGGGCAAACACAAAC
TGGCTCTTCCTGGCGAAGCTCG SEQ ID NO:292 25118 Arabidopsis thaliana
GAACATCAGAAAAAGGCATGTAATATTAATTCAGCCAACATCTGTGGATATGCAGGTGTTGAAGAGAAA
CGGTACAAATTAAAGTTGATTTCTTTTACTTTGTTACAGCTACGTACCATACAATCACCCAAACATACA
AAACCTTAAAAGACAAAAGTTGGCATCTCTATCAGTTGGGTTCTAGTCAATCTTCACTGAGGAGTAGAT
CTTTCTCACGAACCAGAAGCAAGCATAGAAACCGATTGTGCCAGTTAGGACGAAGAATGCGTAAGAGAT
GATAATCATGTACCCGAAGTAGAGCATTCCCGAGACTAGCTTTGTGATCTCCAGCTTTGTGAAGAAGTA
GAAGATTGAGTAGAGGAAGAGGTAGAAAGCGGATGAGCCCGCAGTTAAGTAAGCTCTCCACCACCAGTT
GTAGTCTTCGCTACAAAGCTGGAAGTAGCAGAGCACCACTGTGATCTCTGCACAGGTGACGATCAAGAT
CAAAAAAACTATAAAGAGGAACCCGAAGATGTAGTAGAACTGGTTCAGCCATATAGATGTCAAGATGAA
GAAGAGCTCGATGAAGACTGCTCCAAACGGGAGAATGCCTCCAATTAGTATAGAAAACTGGTTTCAT
GTACCACGGCTGCTCTGGTACTTGCCTCGGGATCTTGTTTGTTTTGACTGGATCTTCAATTGCTGGCTT
CTTGTAACCCAGATAGCTACCAACGAAGACTAGTGGGACTGAGATGCCAAACCAGAGGCAGAAGAGAGC
AAACATTGTACCAAATGGTATGGCTCCAGATGACTGTTCTCCCCAAATAAGGGCATTCAGAACAAAGAA
GATAGCAAAAGGATACCGGGAAACATGAATGCAGTCTTCAAGGTCATTCTCTTCCACTTGTTTCCTTT
GAACATTTTGTGAAGGCGAGACGAGGAGTAACCAGCGAATATGCCCATGAAAACCCACAAGAGAACCAT
GGCAGTCATAAGCCCTCCTCTGTTGGATGGAGATAAGAAGCCAAGCAACGCAAACATCATTGTAACAAG
TGACATTCCGAAGATCTGAACACCTGTACCAACATAAACACACAATAAACCAGAGTTCACCGGTGGCCT
GAAGACATCTCCGTGTACAAGCTTCCAT FIGURE 7d SEQ ID NO:293 25124 Arabidopsis thaliana
CGGCCGCCCTTTTTTTTTTTTTTTTTTTTTTTTTTTTTTCCAAGCGAAGGGCTTCCATATTCTTTT
TTTGGAAAATAAAAATTGCATGTGCAATGGTCTTCACACATTCCAGATATTAACACAAAGTATTGAAGC
ACGAAATAAAATAAGGATAGATTGAAAAGAAAAAAATAGAAAACACACCACTATCAATGCGCAACCCAA
AACCCTATCAGACCAGATTCTCTACAACATCCTACGGTCATCATCACACCCTCACACTCGCCCTTTCCC
TTCTTATTCGATGCATTGGTCCAATCAATGCCTTGGTCCAACGTTGCTGCCACAATGTCTCCTGACATT
TGTGTTCATGTTTTGGGGCTAATTGTATATTTTTACCGGCTTCTCGTAAGCATGGCGGTTCTGGTTTGC
AGCATAAGCCCTCTTAGGAGTAGTGTCAGCATGCTCCAACCCGAGGTACTGCTCAAAAGCACCATAGAC
ATCTCTTCTCTGGAAGCGATTATAAACAACATCTGTGTCCTGCAAGTACTCTGGACGCCCATTGACAT
GAACGCAAACTTCCACTTGGCAAAATCTTCATCAGATACATGAAGCTTCTTTTCGGACGCGTGGGTCGA
CCCGGGAATTCCGGACCGGTACCTGCAGCGAGGGGTAGTCAAGATGCATAATAAATAACGGATTGTGTC
CGTAATCACAC SEQ ID NO:294 25133 Arabidopsis thaliana
CGTGTTCTTGTCATTAAAGCGGCCGCCCTTTTTTTTTTTTTTTGAAAAAGCAGGAATGAATAATACAA
TTTGCCAATGCCAACTGTCTCACAACAAGAACAAGATGTCTCTGATTTACCACAACAAACACAGGATGG
ATTCAGATCTTATTGATTGTACAAATTTGCGAAAGGAAGACTTGAATGGGCTGTGTTGAGACCCTCATA
ACTCATCTCGTGAACCACTTTTGCTTTCATATGATGCATAAGCTTTGATGATTGAAACATACACCTCAA
TGCCTTTCAAGTACTCAGCTTTACCCAAATACTCATTGTGGTCATGAAGCAGACTCGGGGTGTTTGATA
TGGGAGAGAACCCAAAGGCAGGCACGCCAGCCTTGCGAAAGTAGCGAGCATCCGTTGATGCAGGGAAAA
TCTCAGGCTTACTGGTCCTACCTCCGGCTTCCTTAACAGCATTTTCCAAGAGCCCCCACCAAGGATTTG
AATCATCTGCTGCTGTAAGGAATTGCTTCCCCGTAAGCTTCTGCTTGAACTCAAAGGACATGTTTCGTG
CTGCTGGAGCCCATTCCTCCACTAAACGTCTTTCGAGTGCTTCAGCATCAACGCTGGGTGGAACACGAA
TGTCGAAACCAGCTTCTGCCTCAGATGGTTGCAGATTCATTACGAAACCAGTTGGAGAAGGTGTGCCAG
CCTTGAGGAAGGCCATGTTCACAGAGACAA
CATCGCCTTCAGCTATCCCACCAGCTTTGAGAAGATCGAACTGAGAAGCTCTGAATCTGCGAATACTCT
CAATGCTTTTGAGCAGATTCTCCATGGCAGAGTTGTCATAGAGCTTGGCACCGTGGCCAGGTGGACCTT
TAGCCTTAATCACCAGCCACCAGGGACTCCTCTCTCCATAGAATACTCTGTAACTCTCAGTAGGCGATG
GCAGGCCTTCGTCGAGCACGATTGCGATGTTCAAGCTCTTGAATAATTGGGATTCAGCAAACTTCTCTG
CGCCATCGTGGCCGCCAATCTCTTCATCGGGGACGAAGGAGAGATAGACGGATCGGAGTGGCTTGAAGC
CAGAAGCCTGGAGCTTGCGTATGGCCTCGAGGTACTGCATCCCGACGCACTTCATGTCCTGGGAACCCC
TGGCATAGATGTCGCCATGGTGGTCCATGTGAGCTTGGAGCGGATGGTGAGTCCACTTGGAGTCCTCGA
AGGGAACGACATCGGTGTGGGAGTTGAGGAGAAAGGCAGGTAGGGTTGGGTCGGAGCCAACCCATTTGA
GGAGGAGAAGCGGCTTTCCTTTTACAAATTCGATCGTCTGAGATTCGAGGGACAGTGGTTTCGCCTGAG
ATATTATAAAGTCAACGGCTTTGTAGTATTCCGGGTTGGGCTGAACCGTGTTGATTCGGAGGTACTCCT
GGAATCTGGAGACGATGGCGTCGTCGCCGG
CCACCGCAGAAGATGAAGAACAACAACAACGAGGAGAAGACGAAGAAGACTCATTGAATTGGATTCGG
ATTCTTCCGGACGCGTGGGTCGACCCGGGAATTCCGGACCGGTACCTGCAGCGAGGGGTAGTCAAGATG
CATAATAAATAACGGATTGTGTCCGTAATCACAC SEQ ID NO:295 25144 Arabidopsis thaliana
CCAAAAAGGTTCAAAATCATAACACAAAACAAAAGAAATAAACAGGAAGCTCGAGTGCCAAGTACCTCC
GCCACCTCCGATCAAGAACCCAATTCCGAGAATTGAGCTCCGACGGAGAATAAACGAAGCGGTAACACA
AACAACCAACCAAATACCAAACTACTAAAGTAAAGAAACTAAAATAGTCCTTCATTTCATCAGCGGAAA
GAGTTTTGATGTTCAGAGTTCACTTGGCACCCTTCTTGA FIGURE 7e SEQ ID NO:296 25164 Arabidopsis thaliana
TGTAACCATGCCTTCTCTCTACGAAAAATCGGAACTTTTCTCTGTCACAGAGAATTTTCTAAATCCGAG
ATTCACCTGGACCATTCGGGGATTCTCTACGCTGCTAAAAAACAGTTACCTATCAGAAGTGTTCTCCAT
CGGAGGAAGAAGTTGGAATATACAAATCAATCCAAGTGGTCTTGGTACGGGAGAGGGAAAAGCTTTGTC
GATGTATCTTGGCCTTAATGTGAATGAGATATTCAGACCATATGAGAAGATTTATGTTCGAGCCAAGCT
TCGAGCTCTTAACCAACTCAATCTCAGTAACATCGAAAGGGAACTCGATATTTGGTACAATGGTCCGGG
ATATGGAGAATATAGCTGGGGTTTCCCTGAGTTTATCTATTTCCCTTATCTCACAGATTCATCAAAGGG
TTTCGTTAAGAACGATGTGTTGATGGTTCAAGTTGAAATGGAGGCCATTTCTTCAACCAAGTACTTCCC
GAGTTAGATTTTCTCTAAGCAAAGAACTTGTACCTACCTCCATGTGTTTGATTTGTTATCAAATACTAA
TAAGAATTTGATTATGCATTTCAAATACAATTGTTTCTTTTTCTTAAAAAAA SEQ ID NO:297 25170 Arabidopsis thaliana
TTACTTGATAAGGAAAGTGTTTACACCAAAAGAAAAACAAATACAAGATGGTTCAGCAACAAATAACAG
AGATTAACAACATCTCGAGGAAACAACAAGGAAGAGACCATAAATCAATAGCGGGTTTTTTCAAGCAGA
TTTAGCAGCTTCAGCTGCTTCTT SEQ ID NO:298 25176 Arabidopsis thaliana
TTTTTTAAAATTTAAAAACATATTTTCAAATCAATGTAAAATAGAAACGTTGAAGAGAGAAACAACTGA
AGAATGGGGGCAAAGCGCCAGAAACTTGTAAAAACAAGTAAAAGGATTGGCAAAAGTAAGAAAGCACAC
CACTTTAAAACTAACATTAAGCTTTGGATGATGATGATTCTTCTTCGTCATCTTCATCAATGTCCCAAC
TTAAATCTTCATCTTCCT SEQ ID NO:299 25196 Arabidopsis thaliana
GGAAGAAACCCTTATGTATATGATTGCTAAAGGTTGAATACACATCACACTACATACAAATCATTCTCC
ATTCCCAGGTTCCAGTAAACACAACAAACAAAAACAAACACTGAGAAAGGAAAACAAAAATTGTCTTTC
TTGTTTCATCACTGATCAATGAACTCGAACTCATCTTCCTTAAGATGTGAAACAAATTTAACAAGACCA
CGACCTTCAATTTCTTTGAAGAACTCAATCTTATAAGGAAGATTAGCTGAGATTCGTTTCCCTTTCCAA
ACAGCAACGTAATCTTTGAGTTTACCTTCCATACCTTCTAAATCAACCTCTGGAACTCGATTTACATGA
TAAACCTTCAACGGTGCAGTTACTCTAACCCTAGATCCTATCTTCGCCTTCGCTTCCGCTTCGATTTCT
TCCTCTGATGACGGTGAGGACGAAGGATTGGCGTCTGCGTTTATCGAATCTGCGGATTTTATCGCTACA
TCGCATCGAATCGTGGTTCGAGAAGTTTTTCTTGAGCTTGAGTGTTTGATTTGAGATTGAGAGGTGAAT
AGCGAGAGAGGTGCGACGATGCAAGATTTGAGAGCCATGGGGGTGGCGGTAGCAGTAGTGGCGGAAGCG
GATAGACAGTCGTGAGAGGACGGACGGCGAATGGCGGCGGCGATGGCCGGTGACAAAGCGATTTGGCTA
CTCATATC SEQ ID NO:300 25421 Arabidopsis thaliana
ATCTGAAGTCTGGCAAGTCATTTATCAAACTCGGCGGAGCCAAATGACAAAGTAGACCCGCACGGTCAT
TGAATAGTACGTGTACAACATAAGCAGTGTTCAATACCAGTATTTGTCTCTCTCTTCGTTGAACAAACC
AAAGGATCTGCAAATCATCACTCTCTACTTCCGATCTCTCCGCTTCCTTTCTGCTCTCCTCTTGTCGTC
TTCCCATTCACGGTCATAGATTGGGTCAGGATCACGACGAGCCATTTTGCTGGAAGCTTCTTTTCCAAG
AAGTCTGATGCTTGGCTCTTCAAGATAACCTCCGTGTTGAATCATACTACTGCTCTTCCGCTCTCTGCC
TTCGTACGATGATGGTCCCATACTGGTCGATAAAGACGAATGATGTGGCATAGGAGAGTATTCTCCTGG
CT SEQ ID NO:301 25425 Arabidopsis thaliana
CTAGAAGGTTGTTTCCCATATTATATCTAAACTGAGAAGATGAAGTCGTGAGACAGCGTTGTCTAGATA
TATTTGCACACAAGGATTTAAACTCCAGATGATCAATCGAACATCATCATTCATCGACAGACACCATTG
TTTTTACTTTAAGGTACGAAAGAAAAGCTTGAAGACCAACAATGGAGAAGCCCCTCAAAGGTAGGCTTT
GAGAGTATTAGAAGAAAGTTCCTTCGGGAGGTTGAACAAGCTTCCGGTTATGCGATGCAGCCATCTC FIGURE 7f SEQ ID NO:302 25431 Arabidopsis thaliana
CAAACTTATTTGTTGTATCTAAATATATTACAAAGTTTCAACCCAAATTTACAATCTTCTCTGGAGAGA
TACTTCATAAAGCAAAAACCATAAAGTTCTAATCAAGAGAATCTCACTCTACTTAATTAACAAAGATCT
TTTTTAAAACATCCTTCCAAGCTTTGTGATGAGTATGCTTCTTCAAGACTTTTGATTCTGCTGTTTCTT
GTTTTTAAAGTTTTAATAAGTTCCTCTTTTAAGTTGGTTCTTGTGGACGAGCTGCCCAAAGAGAACTAA
GAGCACGAAGTCTATGAAGATACTCTCCTAAAGCTAGTAAACCTCGAGCCGATTGTCTTGTCGTTAAGA
TCTTCGCCATTTGTTGCAAAGTTTGTTGCCTCAGATGATCTGCTTGATTCACAAATCCTTCTAATGCTT
GAAGATTCTCTATAG SEQ ID NO:303 27410 Arabidopsis thaliana
ggCAACACAAAACTTAAAAAAACAAAAGCAATATTTTTTTCACCGACAAAAACAATAAGCAATACACGC
AAAAGTTTAACAAATCCAGAACCGATATAGGGTTTCAATAACAAAAACGAACACACATGAACGAAACAA
TAAAAGAGATATTACGAAGAAAAAAATTCAGGATAAGGGGAAAGAAGAAAGTGAATGCTGCTTGCTTAC
ACAGCTTACGAATCCGAGGGAGCCATTGACAACATCTTAAGTCTCGTACTCCTCTTCTTCCTCCTCGTA
CTCTTCCTCTCCGGCTGTAGCATCTTGGTACTGCTGGTACTCTGCGACAAGATCATTCATGTTACTCTC
TGCTTCAGTGAACTCCATCTCGTCCATGCCTTCTCCTGTGTACCAATGAAGGAAAGCCTTTCTCCTGAA
CATAGCTGTGAACTGTTCGCTCACACGCCTAAACATCTCCTGGATTGAGGTTGAGTTACCAATGAAAGT
AGACGCCATTTTCAAACCCTTTGGTGCAATATCACAGACACTGGACTTGACGTTGTTTGGGATCCATTC
CACAAAgtaggatgagttcttgttctgaatgttc SEQ ID NO:304 27424 Arabidopsis thaliana
TCTTCGAGATATTAATTAGTATGGTTCCATAGTTTTTGTCCGGTATACACATTTAAAACTAAACCAAAA
TCCGAACCGGACATTTTCTCTTACAGTTAGGTATAACAAGAGAGAAAATGACATGTACAAGAAATGTGA
AGGAAGATTACATGGATTGGATTGCTATGAACATTGGTTTGGGTTCTGGTCTAGTACCAGTTTTAGACT
CCTTAACCGGGACTACTGCATCTGGAACTCTTTGACATATGTTCTTGATAGAAAGGATCATCAGAGCCT
TGAACTGAACTCAGTCTTGGAGATGAAAAACTGTATCCTTCCTTATGCATTGCCTCGTGGCAGCTTTCT
TCTTCTTTGAACTTGATGAAGTAGATGGATGACCAGTAATCTCTTACCAAGTTCATCTTGATCAATTGC
ATGACTTCGTTTAATGCGTTCTTGAAGAGATCAGTGTGAGTTAGATCTTGAGTGGTTAAGATCTCTTGT
CGGGTTTTATGAGATAAGTTCAATTCCATTTCCGCTCCTGCGACGATGAACTTCTCCATGATATGTCGA
GCCATGTAGATTCTTCTTATCGAATCCGGACGCGTGGG SEQ ID NO:305 25427 Arabidopsis thaliana
TTTTTAGAGAGTCAAATTAGAATCTTGTTTCAAATACCATCTTCAAATGCAAGAGATAGTAAGAGAGCT
CAAAAGGTTAAACCAAGAAAGTAAAATGACATTATTAAGGTCGACGAGAATGTACAATCATCAAGAGGA
TCAGACGTAGAAGCTGAGGTAATTAGCAGTAGAAAGATCCACCAAATGTGTTCTCTCCACTGTATGTCA
TGTAGAGAAACCCGTCTTCGTCTTTGTGTTCTTCGTAGATTGCAGACATCAATGCCGCAGTTGGTGGTA
ATGTGTTCTTGACAAAGACAAAGATGGCTTTTTCAGCTCCAAGCTTGATTCTTTTCCTCACAACGTACA
CAAATTGGCCAATGGTTAGATCAGCTGGTACAAGATACTTCTTCTTGTCAATGTCAGGAACATCACTCT
GTCCAGCTTTTCCACAATCACGGGAACTCTTTCAGGCGGACGCGTGGG SEQ ID NO:306  27430 Arabidopsis thaliana
TGGGTTTTTGTTTTGAACTCTCCTTATGTATTACCGCCTCGCCGGAGACTGATACAGTTTCTTCTGTCC
CTCATTGAAAGAAGAAAAGAAAACAAAATAGAAAAAAAAGAAAGCAGAAAAAAAGCCTAGGAGGAAC
AATGAATTTAGAAAACCAAACCATGACAGAAAAGTCTGCGGGATTCTCTGGTTAGCTCTAGGTGATGAT
ATGATCAAGTTTCGTCCTCACTGGCTTTGTATGAAGGGAAAAGAAGATAATCTAAAAGATTCGCCAAAA
GACACAGATCGTTCACCGTGATGGCTCGCCTACAATATCGTGGTAAAACAAAAACGATTGTACTAAGTA
GCAATTCCTCTGTTTGGTTGTCTCTTGTTCACACTGTAACTGCCAACATAACCTGGAGATGAACTTCTA
GCTGAAACATCTGAAGAAGGAACCCCTCCTCCAATCCCATAGCTAAAGGAGCAGGCCCTTCTGTCTCA
GGAGTTGGTGATCTCCATGTAGGGTCACTATAAACTGCACCATTCCCGTAAAACTCTGCAAGTCCTGCT
GTATCATAACCCGTGTTGTTGGTTGCTGAGGCAGAAGAGAATGAAGAGGATGGTGCTGCCTTGTTAGCC
CCTGGGTTTCTTGCTGCATAACCACCTGTTCCCAACCCAAAACCAGATTCACCGTTTCCGGACGCGTGG
G FIGURE 7g

SEQ ID NO:307 27440 Arabidopsis thaliana
cgcaacagccgctggCGATCATGGTGCCGGCGTGGATGGAGTACGACGTCATCGCGCAGATGGTGGAGA
ACATGATCAACGTACTCGATTACCGCGAGTACGTCGTGTTCGTCGGCACCTATCCCAACGACCAGCAGA
CCATCGACGAAGTGGAGCGCATGCGCCGCCGCTACAAGCGCCTGCGCCGCGTGGAAGTGCCGCATGACG
GGCCGACCAGCAAGGCCGACTGCCTGAACTGGCTGATCCTGGCCATCTTCGATTACGAGAAGCGCCACG
ACATCGAGTTCGCCGGGGTGATCCTGCACGACAGCGAGGACGTGCTGCACCCGATGGAACTGCGCTTCT
ACAACTACCTTTTGCCGCGCAAGGACATGATCCAGTTGCCGGTCACCTCGCTGGACCGCGAGTGGTACG
AACTGGTGGCCGGCGTCTACATGGACGAGTTCGCCGAATGGCATGCCAAGGATCTGGTGGTGCGCGAAA
GTGTTCCGGCATGGTGCCGTCGGCCGGTGTCGGTACCTGCTTCTCGCGGCGCGCGCTGCTGGCGCTGA
GCGCGCAGACCGACAACCAGCCCTTCAACACCGACAGCCTCACCGAGCGGACGCGTGGG

SEQ ID NO:308 27459 Arabidopsis thaliana
TTTTTAGAGATCTAAAGCATGATCGTTCATAGAAGCAGAGAATTAATACAAACTTTCTGGTACTTTTAG
TATATACATAACTTTGTCCATATCTAGTCTCTTGGCTTATTATCTGCCGTACAAATTTTATAGATTCAG
TAACCTTGAAAGAGCCTAGCATAGAAGCCTAAGCAAATTTGATGGTTTAAACAGTTTTGTAGAGCTGTG
ATCGTGTGGGTGCATGAACTTGCAGTTGGGACAAACAGGAGTTGATGTACACAACATAACCAGCATGTG
GCATTTCATGCAAACTGTTGTTACCATCTCTTGCCCCTTGTGATCAACATCGTCGGACGCGTGGG

SEQ ID NO:309 27460 Arabidopsis thaliana
AGCGGCCGCTCGCGATCTAGAACTAGGCTTTTACGAACAGAGAGCGAGCCAGAGAGAGTGAGTAAGAGA
GAATGACGAGCGTGAGTGGGTGTGGTTCAGTGAGTCTGATAACTAACCGCAGTGCGTTCTTGGGAAACG
GACTTCAACACCGTGCCGTTTTCCTTAAACCATGGTCGTCTTCTTCGCTTCAGTCTCGGTCCATGGTTG
TCGAAGCCAAAACCAAAACCAGCAGCGAAGACAGAATCGCCCGCCACTCTCGTATCCGTAAGAAGGTTA
ATGGTACAACGGAGAGGCCAAGGCTATGTGTTTTCCGATCAAACAAGCATCTTTATGTTCAAGTGATTG
ATGATACCAAGATGCACACCTTAGCTTCAGCTTCCACTAAGCAGAAACCAATCTCTGAAGAGTTCGACT
ACACCTCTGGACCAACCATTGAGGTAGCGAAGAAAGTTGGGGAAGTGATAGCAAAATCTTGCTTGGAGA
AAGGTATCACAAAGGTAGCCTTTGACCGTGGTGGTTACCCTTACCATGGACGTATTGAGGCTCTTGCTG

SEQ ID NO:310 27468 Arabidopsis thaliana
AGTTAAATGGTTTGGGATTTAAGAAAGTTTTCTTCTTATAACAGAGTTGGTAAATTTAAAATACAACGG
AATATAATCGAAACAATCAGTGAAACTATAGAGATATATTGATCACTTTTCAATTTTTCATGACCCAAA
ACCTCTCAATTTCTCCAGCGGTTCTTCCTGGGATCCTCCCAGCTATCAGTTCCCACCTTTCATCAAATA
ATAACACACAAAATTCAGCTTTTACTATGGTGTTACAATTAAATTATTTTCCTACGAAATAGTATTCAT
TATTAGTTAAAAGATCAAACCTGTCACCGACAAGCTTATGCATTCGAGAGACCAAATCTTCTTCTTCTT
GACTCATGTTCACAACTTCCCACTCAAGACTACTCACTTCTGTTCCTTGTCATCACCAAAATTCAGATT
TCTCATTATATATAGATAAGTATAAAAAAACATGGAAAAATGAGAAAACGAAGGTGTTTAAGTTTTCAG
CTTACCTTCAGAAGAAGAAGTAACGATGGAGTTGGTCTTGGGTTGCTTAGTCCTGCGATGGTTATCCAT
GTCAAACGGCACCGTATTACAAAGAAGAAGAAGAAAGAAACTAAGAGAGTACTCTGAGAGAGCGGACGC
GTGGG

SEQ ID NO:311 27819 Arabidopsis thaliana
CCGCCCTTTTTTTTTTTTTTTTTTTTTTTTTTTTTTTTTTTTTTTTTTTTTGAAAATGTGGAG
GGAGTTTTCAAACTTTGCTAAGGAAGGAGAGATTTGATCCGTTAGATATCGAACAACATAAACGCAAA
ACCTAATCCAACCCTAAAACACGAAATTAGGGAAAACGAAAGATATACATAAGCATAACGATCACAGTC
TAGAGTACTTCAATCTCCTTCTTAAGCCCTCTCGCCTCTAATTCTCCTCGCCAATTGAATATCCTTAGG
CATGATAGTGACTCTCTTAGCATGAATCGCGCAAAGATTGGTGTCTTCAAACAATCCAACGAGGTATGC
TTCAGCCGCTTCCTGAAGTGCTGCGACGGCGCTGCTCTGGAAACGCAGATCTGTTTTGAAATCCTGAGC
GATCTCACGAACCAAACGCTGGAACGGAAGCTTGCGGATCAGAAGCTCAGTGCTCTTCTGATACTTCCT
GATTTCTCTTAGGGCAACAGTTCCAGGACGGAATCTGTGTGGCTTCTTTACTCCTCCGGTCGCCGGAGC
TGATTTCCTCGCCGCCTTTGTTGCGAGTTGTTTCCTTGGGCTTTTCCTCCGGTGGATTTCCTTGCGGT
TTGCTTGGTACGAGCCATTTGGTATCCGAAGCTTTGAGATTTGTGATTAAGTGTTGAAGATTTGTGAGA
TTTGATGAAGCGGACGCGTGGGTCGACCCG
GGAATTCCGGACCGGTACCTGCAGCGAGGGGTAGTCAAGATGCATAATAAATAACGGATTGTGTCCGTA
ATCACAC FIGURE 7h

SEQ ID NO:312 27864 Arabidopsis thaliana
CCCTTTTTTTTTTTTTTTTTTTTTTTTTTGATAAATAAGTAAAGACTATCATTCATTAACCAT
TATTAATTCCTCAACTAAAGTCATTAGAAAAAAAGAAAGGCTAATTAATTAACTCGAAGATGCTGGCTG
GGGTTAAAAAATTAACCCAGGGGTTTGGTTACAAACTTCTTACATCACGGACGGGGAGGGTTATAATAA
TAAAGGAAACTTAACGGCCGTCAGCGAGAGGGTTAACGGCAGATTCCTTGCAAGGACTTGGAGGTAGAC
TTGACTTTCCTGACGCAACAAGACGTTGCACGAAACCCTCTATTCTTTCTCCGTTACTCTCCGTTAGTA
TCCGTTTTACCCCAAACGGCGCCGTTTCCACACCTCTCTCTTTCAGCAACTCCTCCGCTCCGCCGCTCG
TCAAACCGTTCGCCTGGATTCTAACGTAATCAGTACGGTTCCAGCAGAAAGCGTTCCCCAGCATCTGAT
CGACGGTATCGGAAACGCCGTCAACCACTATGTCCACCACACTTGACGTTGAATAGTCTCCGTTACGAC
GGAGTTTCCTCCCTGGTGATGATGACATGGTCGACGGACCGTTTCCCAACGACAGTACAAGCAAGTCAT
CTACGCCGTTTACTGACGGGAAATCTCGTTTGTTGTGTAGCACGTGCGTGACGGCAGCTGCTGTTGGAT
TGTTCATCACCAAACCGCCGTCTACGGCTG
AGCATGAGGTTTTCCCGTCCACCGACACTACACTGAACGGCTTGAAGAGGCTTGGTGTTGCTGACGTGG
CACGGCAGACTTTCCACAGCTCGAAGTCGAAGCTCGCGGACGCGTGGGTCGACCCGGGAATTCCGGACC
GGTACCTGCAGCGAGGGGTAGTCAAGATGCATAATAAATAACGGATTGTGTCCGTAATCACAC

SEQ ID NO:313 30087 Arabidopsis thaliana
TTTTCATCTCGTTTCTAATACTACGATGATCTAGAGAAAGTACACAACCCAAACAAAACAAAGAGGACA
ACACGATTTGCTTCATACAATATTAATCAATAATTTTTGTAGCCAACAATACGTAGGAACACATTACAC
AACAATCTCTCAAAGACCGAGCGAGAAGGGGAAACCGGTCGACGATAACCAGCCTCCACCACCAATAAA
CTGACCAGCCGTATATTTTTGAGCTTCAGCAGCAGCCGTAATTACCTTAAAGCCCCTCCACTTCACTCT
ATTTGCAGTTCCAGCCCCTGCTCCTGTGTTCGAATACTCTCTGTAAGTCAGAGTGTTCAACGCAAAAGT
CCCGGTCCACTCGGACCACCCTTCGGGTCGGATCACGTCGGAGATAGCCGACTGCATTATACCGTTTG
TGAATATTCCTTCCATGGCCGACCCAAGTACGTCGGAAAACTACCTTTCACCGACTGTAAATCCGACGT
GGCACCGATCCTACATTTCTGGATAACGATCCCTGTGTTCTGGTTAGGGATCCGTTCTTCCCTGAGCTG
TGACCATGTTTTCTGACCGGAATTAGGGCGGCGAGCGTGGATGTCACAGTCTTGGAGCACGACGGCGGC
GTTTCCGAAGATGAAGTCAACGGTTCCGGCGATGAGACATTTGACGAAGAATTGACGGTTAGAGTGGAC
GTATAGAGTGTCTTGATAAGCTAACATGTC
GCAATTGTAGAAGGCGGAGAAATCAGAACCCACACGGAGAGCCACCGCTTGGTGCTTCGACGGACCCGC
CGTGTTTTGGAAAGTGATGTCACGAGCTAAGAATCTCTCGCCGACAGCAGCAACGGTGGCGGAGTGGAA
AGTGGTGCTACCGTCTACAACGTTTCGACTTCCGGTGATAATAGTTCTCGTCCGACCATCTCCCATAAA
CATTATATTCTTTTTCTTCTTAGCAACCTCCACATTCTCTCTGTAAACTCCGGCTTTTATATGTATCAC
ATACCTCTTATTACTATTTTCAGGGGCCGCGGCAACCGCAGCAGCCACAGTTTTAAATGTACCGCTACC
GTCAGCTGCCACGGTGGCGTCAGCTTTCACACCTGAACCCTGAAGAAG

SEQ ID NO:314 30307 Arabidopsis thaliana
CGGCCGCCCTTTTTTTTTTTTTTTTGTGTATTTAAGAAATCTTGGTAGTTGGTATATATAGTTTTGTC
AATGCATTTCTCGACAAAATCAATGCTTTCCATTTCTCGACAAAACAATTGCTTTCCACAAGAGAAGTC
ATCCAGTAATGAGCTTAAGCAGAAGAATGATGTGCTAGAGAATCATCTAAAGGTGCATCTCTGAAAAGG
TCATCATATGAAACAGGTACCCTGATCCTCTCATGAACAGATTTCCTTTCCTTTTCCGGTTTGGATTCA
GTCTGGTCAGCTACCGGCATAACACACATCTCGCTCACCAGAGCTTCATCAGCAGATACATTTCCAGAG
GCAACTCCTTCGGAGGAGCTACCCTGATCTCTTTTGGGCCCTGATTTGGTCTCGTGTTTGGTTGCCTA
AATTGTTTCTCAAACTCCTTGGTCTTTTTCATTATCTCTCTATAAGCTTCAGGCTGTCTCGCTTTGATG
ATGTTCCACAATACACCACCACTTGTCCGTTTCCTAGTGCCATCAGCAGTCACCTGACCTCCACAGGTC
TCAATTGCTACCACCTCATTGACAAGATCACTTAAGGCAGCAATTCCGAGACACCCAACAGCTGTGTAT
ATCATGTAAGACTTCTTCTCCTTGAGGCGTCTACAAGTTTCCCTAACAAACCAGTCTACACTCATGGGT
TTGTCCATCACAGGGCCTTTTCTCTTTTTC
TTCTTCTTCTTCCTCTTGTTCTTGTTTGTCTGCTGCAGCGAGGGGTAGTCAAGATGCATAATAAATAAC
GGATT FIGURE 7i SEQ ID NO:315 30913 Arabidopsis thaliana
GATATCTTTACAATTTCGCCTGATGCGGTATTTTCTCCTTACGCATCTGTGCGGTATTTCACACCGCAT
CAGGTGGCACTTTTCGGGGAAATGTGCGCGGAACCCCTATTTGTTTATTTTTCTAAATACATTCAAATA
TGTATCCGCTCATGAGACAATAACCCTGATAAATGCTTCAATAATAGCACGTGAGGAGGGCCACCATGG
CCAAGTTGACCAGTGCCGTTCCGGTGCTCACCGCGCGCGACGTCGCCGGAGCGGTCGAGTTCTGGACCG
ACCGGCTCGGGTTCTCCCGGGACTTCGTGGAGGACGACTTCGCCGGTGTGGTCCGGGACGACGTGACCC
TGTTCATCAGCGCGGTCCAGGACCAGGTGGTGCCGGACAACACCCTGGCCTGGGTGTGGGTGCGCGGCC
TGGACGAGCTGTACGCCGAGTGGTCGGAGGTCGTGTCCACGAACTTCCGGGACGCCTCCGGGCCGGCCA
TGACCGAGATCGGCGAGCAGCCGTGGGGCGGGAGTTCGCCCTGCGCGACCCGGCCGGCAACTGCGTGC
ACTTCGTGGCCGAGGAGCAGGACTGACACGTGCTAAAACTTCATTTTTAATTTAAAAGGATCTAGGTGA
AGATCCTTTTTGATATCTGCAGC SEQ ID NO:316 34136 Arabidopsis thaliana
CGCCCTTTTTTTTTTTTTTTTAATTCGACAACCAACTTTTAAATAAATAAAAAAAACTCAACAATAGA
GGGAAATAAATAATCCTCATTTACTCTCCCCAAAAACCATAAATAAAAGATTCACAAAAAAAAAAAAA
CATGGAAGAATCGAAGAAACAAGAAGTGAAACTATAGAAGCCAAGAAGAAGCAAACAAGCAGAGCAAGC
TCACCACCAAACCAGCCTTAGCTCCTCCGATGATCCTAACCGCACCAGCATCATCTGCCGTCGCATCAT
CGGCCTCTCCGTCAGGCCCTTCGGCAGGCGAATCCGAGTCACCAAAAGGATCATTATCTGGCGACGGTG
CAGCCTTCTTCTTCTTTCCTTTCGCTTTCCCTTTAGCCGCTTTTGGAGAATCCGCAACATCACCATCCT
CTGGTGCCGGAGCAGGAGCCGGAGCTTCAACAGCCGAAGCCTTAAACAACTCTTTAGGCAACAAAACCT
TATCAGTCGCATATATAGCTAAAGGCTGCTCATCAATAAGAGTATCAACGATCTTGACAGTGTTGATCC
TTGTCTTGAGGGTAACCTTCTCTCCATCGTTCTGTACAGTAAGCTCAAACTTGTTAGCTCCATCTGTCG
CAAGTGTGTTCATCGGACCATTGTTGGATTTGGCATCGCCATTGAGTAATATGTCGGGACAGCGAGGAA
ATCGAGAAATGCTTCTTTCTTTGGAGCTGT
CAAGTTCTTGTATTTGGGCAAGAAACCTTTCATTGCATCATCTCCTGGACAGAACACTGTCATGCCTCC
TTCTAAACTCTCCTGATAGGTTTTTGAAGCTCCAGGGTTAGTGAGAAGAGTCTCAGCAAACACTTTGCA
TCCATGAGCCGACATTATTCCGGTAAGATTCATCTCCGCCGGAGCAGGAGTCGGAGCCGCCGCAGTCTC
CGACGGTAAAACTCTACTGATCTGAATAATGGAGATGTTATACGGAACTTCTTCCGGACGCGTGGGTCG
ACCCGGGAATTCCGGACCGGTACCTGCAGCGAGGGGTAGTCAAGATGCATAATAAATAACGGATTGTGT
CCGTAATCACAC SEQ ID NO:317 34442 Arabidopsis thaliana
GGCCGCCCTTTTTTTTTTTTTTTTAATGCTTTTCTAATCAATAAATATCAAATTATCCACCAGATAA
AAATAATAATTTAAAAAGCGTATTCTCAAATCGTAACAAAAAGGGATATTTTTGGTGTTTGTCACCCAA
AAGTATAACCTATCCAATGAGGGTATGAAGAAAATTGAGTGAATCAAAATATAAAAGATAAAAAAAAGG
GAAGACGAAGCAAAACTCTTTTGTATGTTTCTTCTCATTAGCAAAGGCTGGGGTAAAACTTAGAAGTTG
ACTTGAAAGCCACTGCGTCTGCGATGACCTGCACCGCCTTTTGATCTGTTTGAGTTTCTTTCATATTGG
TATCGCATCCCCAAACCCTTACCGCAAGCCTACGACATTTGGGTGATGATTCTCTGAAATAGGTTTTGT
ACCAACTGATCACATCTTTCTTCTGTATACTTCTTAGTTCTTCTGCTTCTTTGTGGGAGAAATCAAACA
TGTACCTTTTGTCAACAATCTGACTCCATAAGTCATTTGTCTCGGACAAGAGAGAGGGATCCTTTTCCA
GCAATCTAGCAATCATACCACTTCGGTAATCTTCATAGGATTCATCATCCAGTTGTTCCAGAAGCCCTT
CGATATCTTTTATGAAATTGTCAACTCTCCCCAGCAAATGAACTGGACCGTACTTAGAAGATTGAACAC
AGAAACAGAAACCGTGCACACGATACGTTA
AGCGAGGGCCACACTCGACAACATAACCAAGCTGCTCCTTTGTCCTCAACTGATTGAACAATGGCTCTT
CTATGATTTCATGAAAGAGATCCAGCACAGCTTTCGTTCTCGTTGATTGAGCTTCTTCAGGCTCGATTT
GATAGTAAAGCTCGACTACTGAGTTTGTTTCAGATTTGTTCTTCACATTCGGACGCGTGGGTCGACCCG
GGAATTCCGGACCGGTACCTGCAGCGAGGGGTAGTCAAGATGCATAATAAATAACGGATTGTGTCCGTA
ATCACAC FIGURE 7j SEQ ID NO:318 37186 Arabidopsis thaliana
TTTAAAATATAAATAAAAGCCTAAAACATCATTTATTTAATCAACCAATAAAAATAATTTTGCATTGAA
AATTTAAAACATCATTTATTTAAAAACCAAAATGAAAGCTTTAAACATCATTTATAAAAAGATTGGAAG
GAGTATATTTTTATTTGGACAAAGAAGATAATGCTTATGGAATGTCTCTTACTTCAAATGCAAACCTCG
GTAGTACCTGTAAGATACTTTTTTAAATAAGTGACTTGGCTGCTTCAACCATAGCTTCAATGGTGATAC
CAAACTCTTTATAAAGCTTTCCTGCTGGTGCACTTGCTCCAAACGTATCAATTCCAATCGATTTCCCTT
TTCCTCCGACGATCTTTCCCCATCCAAAAGTCGATCCAGCTTCGATACTAACTCTAGCTGATACATCAG
ATGGCAAAACACTTTCCTTGTATCGGACGCGTGGG SEQ ID NO:319 37188 Arabidopsis thaliana
CAGTTCGTGTTCTTGTCATTAAAGCGGCCGCCCTTTTTTTTTTTTTTTTTTTTTTTTTTTTTTTTTTT
TTTTTTTTTTTTTTTTTTTTTTTTTTTTTTTTTTTTTTTTTTAGATGAAAAATCTAACTTTCATCATC
AATATTACACCAAAGCTGCTATAGAATGATTCAGATAGTATACATTGATTTATACACAAAAATATCCCA
ATGATATGCAGACAAAGATAAATTAAAAAACAGGTCAATCTTGCTTGCGAGTATTTGGGGAAGGAGTGT
TGAGAGACAAACCAAGATCTCTACATAACTCTTCATCGGGCTGCAAGCTTCCAGGTATAGCACCAAAAG
CTGTTCTGGAAGCTTCAAATCCAGACGCCAAGAAATGAATATACGCTGACATATCCTCCAAGTTTTCC
CCACACTAATCGAAGATGACGCAAACACACTTCTCTTTGACAAGCGGACGCGTGGGTCGACCCGGGAAT
TCCGGACCGGTACCTGCAGCGAGGGGTAGTCAAGATGCATAATAAATAACGGATTGTGTCCGTAATCAC
AC SEQ ID NO:320 38919 Arabidopsis thaliana
CTCAAAATCTTAAAAACTTTCTCTCAATTCTCTCTACCGTGATCAAGATGCAGATCTTTGTTAAGACTC
TCACCGGAAAGACAATCACCCTCGAGGTGGAAAGCTCCGACACCATCGACAACGTTAAGGCCAAGATCC
AGGATAAGGAGGGCATTCCTCCGGATCAGCAGAGGCTTATTTTCGCCGGCAAGCAGCTAGAGGATGGCC
GTACGTTGGCTGATTACAATATCCAGAAGGAATCCACCCTCCACTTGGTCCTCAGGCTCCGTGGAGGTA
TGCAGATTTTCGTTAAAACCCTAACGGGAAAGACGATTACTCTTGAGGTGGAGAGCTCTGACACCATCG
ACAACGTCAAGGCCAAGATCCAAGACAAAGAGGGTATTCCTCCGGACCAGCAGAGGCTGATCTTCGCCG
GAAAACAATTGGAGGATGGTCGTACTTTGGCGGATTACAACATCCAGAAGGAGTCGACCCTTCACTTGG
TGTTGCGTCTGCGTGGAGGTATGCAGATTTTCGTCAAGACTTTGACCGGAAAGACCATCACCCTTGAAG
TGGAAAGCTCCGACACCATTGACAACGTCAAGGCCAAGATCCAGGACAAGGAAGGTATTCCTCCGGACC
AGCAGCGTCTCATCTTCGCTGGAAAGCAGCTTGAGGATGGACGTACTTTGGCCGACTACAACATCCAGA
AGGAGTCTACTCTTCACTTGGTCCTGCGTC
TTCGTGGTGGTTTCTAAATCTCGTCTCTGTTATGCTTAAGAAGTTCAATGTTTCGTTTCATGTAAAACT
TTGGTGGTTTGTGTTTTGGGGCCTTGTATAATCCCTGATGAATAAGTGTTCTACTATGTTTCCGTTCCT
GTTATCTCTTTCTTTCTAATGACAAGTCGAACTTCTTCTTAAAAAAAAAAA SEQ ID NO:321 45801 Arabidopsis thaliana
GCGCGTCTTGGTTGTAAACACCGACCCTTCTATCGTGTAGTTGTCGCCGATGAAAAATCGCGCAGGGAC
GGTAAACAAATCGAGGTGTTAGGCTTTTATGATCCACTCCAAGGCAAAGAAGATGCGGATAGAGTGAGC
CTCAAATTCGACAGAATCAAGTACTGGTTATCTGTTGGAGCTCAACCAACAGACACAGTGGAAAGCATG
CTTTTCAGGGCCGGTTTGATACCACCAAAGCCTATGGTAGTGGTCGGTTCAAAAAATGGGCAGAAGTCT
ACGAGCCAACATGTTTCACCCATTACAGGTGAAATCTTGAACTAAGAGTGTTGATGCGTTGAGCAAGAA
AGAGCCTTTTGTGTCTGTGTGAAAGGAGTTTATGTAATGTTGTTTAAGACTTTTCTGTTTATGTGAAAG
GAGTTAATGTAATGTTGTTTAAGACTTTTGCTTTCTATGTGAAAGCAGTTTAATGTTATGTT FIGURE 7k SEQ ID NO:322 45804 Arabidopsis thaliana
CGCGCAATGACATCATCAAGCATCCACATATCCACCTCGGAAACGGACTCATCAAGCTGACTCGGTTGC
TCCGCCGTGTTACCGTCCAGCTCAAGGAACGATTCCAAGCTCGATATCTGCTGTTTCAGATCATAATCC
GGCTCAAATCCGTAACTCAGGTTCTGAAACTCGTCCCCATTTCCAAATCCTATACACTCCACCGGGAAA
CTCGGCTGACTTAACTCGCTCTCACTCTGAGAGACAACGCAGACCTTCTTCGCCGGAGGCTGATCGGTT
GATCGTGGCGATGACGGCGGAGGAGTATAATTAGGAGGAGGAGGATGGTGCAGATCTGGGAAGTTGAGC
TTGGCTTTATCACCACGGATCTGCTTGGCCGCAACATCATAAGCCATGGCAGCTTCCTCCGCCGTGTTG
AACGTACCAAGCCAAACTCTAACACCTTTTCGTGGATCTCGAATCTCAGCCGCCCATTTTCCCCATGGA
CGCTTACGTATCCCTCTATAAACATTCTTCCTCTTCCTCCGTTTCCCCGGCTCTGTTGCCTGCTCCTTC
TTCACTGCCTCCTCTTTCACGTTAACTTGGTTGGTGGGATGGAGTTTGGAGGTGGAATAGAAACCCCAG
AAGTCGTCGGCGGCGGAAGCATCGAGCTCTGACCAGAGTTCCTCAGCCGTGAGTTTACGGCCCTTGGCC
TTGGTGACGAGAGGGGCATAATC SEQ ID NO:323 45808 Arabidopsis thaliana
CGCGCAGGAGCTCTTCTTTCCTATGACCCAAACCTCAGGGAGCCTCTGTGGCCATCAAAAGAAGAAGCC
AAAACACAGATCATGAGCATTTGGGACAAAGCTGAGATCATCAAGGTGAGCGATGTTGAGCTTGAGTTT
CTAACTGGAAGCAACAAGATTGATGATGAGACCGCGTTGACCTTGTGGCATCCCAACTTGAAGCTGTTG
TTAGTCACTCTTGGTGAAAAGGGCTGTCGGTATTACACCAAGACTTTCAAAGGAGCCGTTGACCCTTTC
CATGTGAACGCTGTGGACACAACCGGAGCTGGAGATTCCTTTGTCGGTGCTCTTCTAAACCAGATTGTC
GATGATCGATCCGTTCTCGAGGACGAAGAGAGATTGAGGAAAGTGCTGAGATTCGCAAATGCTTGTGGA
GCAATCACAACGACCAAAAAGGAGCCATTCCAGCTCTTCCCTCAGATGCTGAAGTTCGGAGCTTTCTC
GAAAAGAAATAGAAACAAAACAACTCAAGCTTCTATTACGTAATCTGTTTCCGCGATTATCTTCTCTTT
TTGTATTCTTGTTTTCGGATGGTTGAATCGAGAAGAGAAACAAATTCGGCATTCCGCTCTGTTTTTGTT
TCTCTTCTTCAAATGTAATGATTTAGAAAAGACGTATGTTGC SEQ ID NO:324 45820 Arabidopsis thaliana
CGCTGAAAATGCCGGCGGGACACGGAGTGAGGGCGAGAATAAGAGATCTGTTCGCGAGACCATTCAGGA
AGAAGGGTTATATTCCACTCTCCACTTACCTCAGAACCTTCAAGGTCGGCGATTACGTCGATGTCAAGG
TTAATGGAGCTATCCACAAGGGTATGCCTCATAAGTTCTACCATGGTCGTACTGGTCGCATCTGGAATG
TCACTAAGCGTGCCGTTGGTGTTGAAGTCAACAAACAGATTGGGAACAGAATCATAAGGAAGAGGATAC
ATGTGCGTGTGGAGCATGTGCAACAGTCAAGGTGTGCTGAGGAGTTTAAACTCAGAAAGAAGCAGAACG
ATGTGCTTAAGGCTGATGCTAAAGCCAGAGGAGAGACTATCAGCACCAAGAGACAGCCTAAAGGTCCTA
AACCGGGTTTCATGGTCGAAGGTATGACATTGGAGACTGTCACTCCCATTCCTTACGATGTTGTCAACG
ATCTCAAGGGTGGTTATTGAGTTTTTTCCATTTTATTATCATTCTCTACTCAGAATTTTTGCACTTGCT
TTTTTAATGATGTTTTTGTATCAATTAAGACTAATT SEQ ID NO:325 45837 Arabidopsis thaliana
TTTCTTCCTGTGCGACCCTCGAATCCCAATTCAAAGTCCTTTCGCTTAAGGGAATCTCTTGTTCGTCAC
CATCTTCTTCCTTCTCCAATCGTCGTGGTGCTTCGGCTACCTTATCCTCTTCCCTTAGCTTCTCTCAGA
GCGTTTCTCAATGCGTCGCCTTCTCAACCGGGAATTTGTGGGTACAGAAGCCAATGAGGCAATTGATTG
TGTGTGAGGCTGCTGCTCCTACCAAGAAAGCTGATTCAGCTGCAAAGAGAGCTCGCCAAGCTGAGAAGA
GGCGTGTTTACAACAAATCTAAGAAATCTGAAGCCCGTACCCGGATGAAGAAGGTCTTGGAAGCACTTG
AGGGGCTCAAGAAGAAAACTGATGCGCAAGCTGATGAGATTGTGACGGTGGAGAAACTGATAGGAGAGG
CTTATTCTGCAATTGACAAAGCAGTGAAGGTTAAAGCACTACACAAGAACACTGGTGCCCGTAGGAAGT
CTCGATTGGCTAGGAGGAAAAAAGCCGTTGAAATTCACCATGGTTGGTACGTCCCAGACGCAGCTGCTG
CAGCACCATCAGAAGCTGTGCCCATGGCTGCATAAGAACATGGGGATAACGGAAATTTGTTTTTGTTAC
TAGATCTTTCAAAATCAAAATCTGTTTCTTTATAATGTACATTTAGTCGCTTTCAGACTCTTCGCTT

FIGURE 71

SEQ ID NO:326 45850 Arabidopsis thaliana
CGCGGAAACTTCCCTCTTAACCAACAGTCTGCTACTACCGGTACAACGCTTGGTTATGACGATGTTCTT
AGTTCTCAATACAAAGAGAATCATCTGTTGGCACTTCAGCAGCAGCAGCAACAACAGCAACATCAACAA
CAGAACGAAAACTCGGCGATGTGGCATCAGGGTCATGGTTCCAGAACCATGTCAGGTGTCCCGACTAAC
ACGTATTACAACCTCCAAGCACAACAACAACTGCAACTACAACACCAGCAACAACAACAGCAGGCTCAG
CAAGCAGCGGGAGGGTATCGCCAAGCTCAGCAACAACAGCATTATGGATCTCATGGATACCCAAATTAT
TATCAGTCTCAGACCGAAATGTCACTCGAGCGCCAGCAGCAAAACCCTAGGGATGGTGCTGGGTCTCAG
GCTGGTCAACCGTCGAATCAATCTCAGCAGCAGCTCTGGCAAAACTCTTACTAAATAAAGAAAGAGAGT
GGTTTTTTTCAGCTTCTTTCTCTCGCTTATAGAGGTTTGTGTGGCGAGTCTGAAGAGGAAATATGGTTG
TGTTCTAAAATGTAACTTATCATCATCTTTTGTCTCCTCTGTTAACTTAGGGAACATGCA SEQ ID NO:327 45853 Arabidopsis thaliana
CTCAGTTCGTGTTCTTGTCATTAATGCGGCCGCTAATAAAGTACTCGTAGTACAACTAAAAATCTTACA
CAACAAGCTCCAACTGTCAAAACCTCAAAAATTGAAAAACTTCATCAAAGTCTCCTAACGAGTCTACTT
AACGAGGAGGAGAGACAGGCACATTAGCTTTCGCGAAACTGATCCAAGCAACAACACCAATGGCTAGAA
TCACCCAACCCATAGCATCATACTTGGCATCACTACTTTTCTTATTCTTCACTGCCTTTGAGCTCGGCG
GTGCTGGAGCTTCAACGCGACCCATTGGTTGTGAGCCTAAGCCTTGTTTGTAAGCTTCTGCGTGCAGCT
GTGGAGCCTTGGCCGTCATTTCGAGTGATTTCAGGTAGTGTGTATTATCTGGTTGCTCATCCACAGCTT
GTTGAAAGAACTGAGTAGCTAAGTCAAAGTTATGTTTAGCTTCAGTCTCGTCAGGAGTCAGAAACGCAA
ATGAAGTGTATGCATTCCCAATACACCAAACCGCTTCATCTTTCTTTGGGTCAATCAACAATGCCTCTT
CAAACTTTGTGATGGCCTCTTGAATCATTTGCTTTGCATCTGAGATGCTATGAAACTGAGATAACTCGA
GTAAAACTCCTCCCCATCTAGTCAGATTATCGGCATCTAAAGGATTTGACTTGTAGGTATTTTCGGCGT
CTTGACGAATTTGTTCGAACAATAGTATCC
TATCGAACTCAGTGCGGCCGCTCGAGGGGTAGTCAAGATGCATAATAAATAACGGATTGTGTCCGTAAT
CACAC SEQ ID NO:328 45855 Arabidopsis thaliana
CGCTTTTCTCAAGTTCCATTAATACTCGATAGTATATGATCTCAAGAAAAAAAATGTTTTACTTCGTCT
CAAGATAAAATCAAAACCAACAGAGAGTCTAGAATAAAAGTGAATAGATAAAACTACAGCTCCTGAGAA
ATGATAATGGCGATTCCTTCCGATACTTGTTGAAATCTAGCCTCCTCATATGTTGCTAGGGTACATGAA
GACTCTGACTCTAGCTCCCATTGACTTGGGTGGTAGGTTTGAAGTGAACTTAGAACGGACAACACCACT
GTTACCATGAGGCCTAGTGACTTTGCCCCAAATGCAACGGTAGTGAGAACCGTTCTTCTTTGTCTTTGC
CTTGTAGATGTAAGCCAAACGCTTACCCTTGTACCAATTAACCTCCTCTTGAGTGTTCACACCTTCAAT
CTGGACGAGAGAAGTGTTAGGGTATTGGTTCGACTTGGACCTCTTGTAACCGAGGACTGTTCCACGAAC
ATACAATCTAACTCTCTCTCCTTGACGTCCC SEQ ID NO:329 45864 Arabidopsis thaliana
CGCGCTTCTCAGCCAGTGGAATCATCTGAAAATGGGTTTACTTCTGAATCTCCGAAAGAGAGTTCTTTG
AAGCAAGAAGCAGCTGTTGTCTCTTCACCAAAAGCTTCTCAGAAAGTTGTTGCTAGTACGTTTAAGAAA
CCTCTTGTTTCGCGAAAGTCTGGGAAGACTGGTGGTCTTGGTGCTCGTAAGCTTACTACTAAGTCAAAG
GATAACCTCTATGAGCAGAAGCCTGAAGAACCTGTACCTGTGATTCCTGCTGCTTCTCCAACCAATGAC
ACATCAGCAGCTGGATCATCATTTGCCTCTCGATTTGAGTACTTTGATGATGAGCAATCTGGTGGGCAA
AGTGGCACACGGGTGCTTAGCCATGTTGCTCCACCAAAGTCATCAAATTTCTTTAATGAATTTGGAATG
GACAGTGCTTTCCCCAAGAAGTCAAGCTCAAGCTCATCCAAAGCTCAGGTTGAAGAAACAGATGAAGCA
AGAAAGAAGTTTTCAAACGCCAAATCGATTTCCTCTGCCCAATTTTTCGGAAATCAGAACAGAGATGCC
GATCTTGACTCAAAAGCTACCCTTCAGAAGTTCTCGGGTTCAGCAGCTATTTCAAGTTCTGATCTTTTT
GGCCACGGACCAGATGATTCCAACATCGATATCACTGCAAGCGATCTCATCAACCGAATTTCTTTCCAG
GCGCAGCAAGATATGTCATCTATTGCTAAC
TTAGCTGAGGAAACAAAGAATAAGCTGGGAACATTTGCCTCTAGTATATTCAGTGATCTTCAGGATAGA
ATGCTGTAAGAA FIGURE 7m SEQ ID NO:330 45866 Arabidopsis thaliana
CGCTTTTTGCGGAATAAATAACTTGAGAATCTTCCAACACAGAAAACAAGAAGAGAGAAAAGTAAACTG
GCAGGTAATTTTAATAGGGGACGACGACGAAACACAGGACAATATAAAGAAACATAAACTTAGAGAGTC
GCTGCGACCGACCACAGTAACCCAACGAGAGCTTCTCTCTCAGCACTTGACCTCCTTCAAACCATGAGC
GAAGTACAAAAATGTTGGGTTAGTTGAACCCTCCTTGTAGTAAGCAAAGACCAAAGTGCTGTCATCATG
CATACCCTCCCCAACAAAGAATTGGAAGTCACTGAGCCTGGGGAGCAAAAACTTGGTAGCTCCCTCAAT
ACCCTTCTTGAAGACAGCTTGATCTTCTTCGCTGAGCTTGGGTGTCAAAAGCTTAATGTATTTCTTAAT
GTAAGCGATGAATCCCTTCTTGTCATAAGTTGGTTGCTCCTGAAGTCTGAAGGTGTCGACAATGTCAAC
AACCTTTTGAGTAGAGTCATCAACACCTTCATCCTCACCACCTTCTTCAGCAGATGGATTGGCACCAAT
GTTAACATCTACAGCTCCCACAGTAACCCACTTTCCTTCTACTTCCCAGAGGATTCCATTCTCAATCTC
CTTGTAAGGGAAAGAGTCAGACAGAAGCTCATCACCGGTGAGAAGATCTTGGTACACCAACATGGTCGC
TTATTGATTGTTTTCTCTCTCCGATGGATG
CGAATAAACGAAAATCGAAGGTTGC SEQ ID NO:331 45869 Arabidopsis thaliana
CGCGAAAAACAAATGTATGACTCAATGTGTGATAGAAACAGCGATTTGAAAAGAGAATATAAGAAAAAT
ACGTGAGATCAACCGAGGAGAGAAAAGCCCTGTCCAATTAGGGCAGTGGCAAGAATCTCATTGGCAGCT
TCAGAAGGATGCACACTGTCCCAGAACACATACTGAGTAGCATTGGAGCATGTCCCAAACGATTTCGGG
TTGCACAAGAGTGAAGTTGTCTCGACTGTTCCTGTTCCACAACATCCTTTGGTTGCTTCCGTGAATCCG
GATTTGGAAGGGTTCTGAACAAGATCATAAAGTGGAGAGTAGATGTCGAAGACAACAATCTTAAGATCG
GAATATTGCTTCTGAAGCTTTGAAGCAGCAGCGTTAAGCTTCTTGTTAAAGTTTTGAGCATCTGTGTTG
AGTCTTGAAACACAGCCTTTTTCATGGAAACCGAAAAGGGTTCTTGCAGCGGGAAGACATCCTGTTGGA
GGCAGAGATGTCACACCGATCTTCCTTGCTCCAACCGCATACACTTGCTTGATAAATGTAGAGAAGTTA
TCGATAAGGAAAGATCCGTATGCATCAACAGTGTAAACTTTGTA SEQ ID NO:332 45874 Arabidopsis thaliana
AAAAACAATGGTTGCATTTGAAGTACATTAATGGTCTTTGAACACCAAAAAGAACATTACAAAAAACGA
ATACGAAAAGCAGCAAACAGTTGAGTCACTTAGACATTCTTGTTTTTCTTCATCTTGGAAGGTGGCCAT
CGACCCTTCTTCCTCATCTTACGCTTACGAACCAGACGTTTCCTGCGTAGCCTAATCTTTTTGGCCAGC
TTCATCTTCAGCCTCAATTCCAAGAGCAGTTTCTCTTTAGCTTCTTTCGATTCCAACGGTAGTTTATCC
ACTGGAACAGCAGCAACAACAGTCTTTGGTTCCTCCTTGCTCTCAGGCTCAGCCCCGTCCACGCCAGAA
GCAGCCGCCTTCACCACAATTCTTCCATGGCTAGAGTTCAAGCTGTAAGCACTGAGAGAGACTCTGTTC
TTGGACTCGACAGCGTTGGGTTTAAGGCTCAAAACTTGGAGAAGCGAAAGACGGAGATTGAAGAAGCGC
GAGGAAGAAGAAGAAGAAAGAGAAGAGAGAGAAGGGAGAGAATTGAAGCAGAGAAGAGCCATCTTCTTC
TTCTAATGGAAGAATTTGTC SEQ ID NO:333 56465
TTTTTTTTTTTTTTTTTTTTTTTTTTTTTTTTTTTTTTTTTTTTTTTTTTTTTTTTTTTTTTTTTTTTT
TTTTTTTTTTTTTGCTGAAATTCAAGCATTTAGCATTACACGAATGATCATGGGAGTTTACATTGTC
TTTCTAATTTGTTTCTCTTCTCAAACCGAAAACCTATCTTGACCTGAAGTACAAAAAACAAAAACAAAA
AAGAAAGTGAAAGTCTTTGTGTCTTGTTGCACTTTATTTCGAGATATGAGACAATGTTGTGAATAGCCT
TGTTTCCAAATCAAGTTTCAGACAAAACCCCCTCAGAGAGAATGGTCCGATCTTAAATCTCTTAGAAGA
ATGACTTGGCCGCATCAACAACAGCTTCAACGGTGATACCAAACTCCTTGTAGAGTAAGGGTGCTGGTG
CGCTGGCTCCGAATGAATTAATACCAATGGACTTTCCTTTGCCTCCAACAATCTTTCCCCATCCGAAAG
TCGAAGCTGCTTCAATGCTAACTCTAGCTGATACATCCGATGGCAACACACTCTCCTTGTATTCATCTG
ATTGCTCGTCAAATAGTTCCCAGCACACGAAAGAAACAACTCTAACGGTTTTGCCGTCTTTCCTGAGCA
CCTCCGCAGCCGGTGCATACAAGATCGCTGTCACCAAGCGCAAGACACCATCTATCTTAGCTCTGTCTA
GGCAAAAGCTGCCTCATCTTCCAGGTACAT
CCATCGAAGGAGTGGAAAAGGGTGATATACAATTTCTGACGACTCTTCAGGCAACAAACCCGATGTGAT
CTTGATTGGAACTGGTTCTGAGCTAGAGATTGCTGCACGGACGCGTGGGTCGAGGGGTAGTCAAGATGC
ATAATAAATAACGGATTGTGTCCGTAATCACAC FIGURE 7n SEQ ID NO:334    105039 Nicotiana benthiana
TTGAAAATGAGATCTTGGTATCAATCGCCAAATAAAATTACAAAACTCGAAGATATGTTTTATGTGTAC
ATGGTCAGGAGCATCCATAATCCTATTTCTATCCTCATCTTGGATTCATTTTGGTGGCCACTCCGCTAC
TAAAACTGAAGAAAACAAAGGACAGATGAAGAAATAGTTTTTATTGAAAATATCAGGCTACAGTGAACT
GCCGAGTTCGTTTGGTATTGGTTTCCACCATTATCTCCAATCTCAGTTTCAATATAAAAACAAATTTGG
TAGACACCAGTAACCAAGGGTAAGTAATAAGCCTAAGAAACTTGTTTTGCTGCAGCTATAACAGCCTCT
GCTGTAATTCCGTACTCCTTGTATATTATTCCAGCAGGGGCACTGGCACCCATCTATCAATTCCGATG
GCCTTCCCCTTTGATCCGACATATTTCTCCCACCCAAATGTGGATCCAGCTTCAATGCTAACTCTAGCT
GTAACGGATGATGGAAGGACACTTTCCTTGTAGTCGGCTGATTGTTCTTCGAAAAGCTCCCAACAAACA
AAGGAAACAACTCTCACTGCCTTTCCTTCTTTCCTGAGTTCATCAGCAGCCTTGGCAGCAATTTCTAAC
TCTGAGCCAGTACCAATCAAAATGACATCAGGTTTGTTGCCAGAAGAATTGTCTGATAAAATGTAGCAA
CCCTTTGCTGCTCCTTCAATAGAGCTTCCA
GCAAGTTGAGGTAACTTTTGTCGAGAGAGTGCAAGGATTGATGGTGTCTTCCTCTTGAGGACAGCCACC
TTGTAAGCTCCTGCTGTCTCATTGCCATCTGCTGGACGGAACATCAGAATGTTGGGCATTGCACGGAAA
CTTGCCAAGTGCTCAATGGGTTGATGGGTAGGCCCATCTTCTCCTAGACCGATTGAATCGTGGGTCATA
ACATAAATAACTCCAGCCTCAGACAAGGCTGAAATTCTCATTGCTCCTCTCATGTAGTCAGTGAACACA
AAGAAAGTAGCACAGTAGGGAATCAAGCCAGGGCTGTGTAGAGCAATCCCATTACATATAGCTCCCATA
CCATGTTCACGAACACCAAACCTTAGATTACGCTCCTCTGGGGTGTTCTTTTGGAAGTCACCAAACATT
TTCATGAGAGTCATGTTTGATGAGGCGAGATCAGCACTACCACCAAGGAAACCAGGGAGAACCTTGGCA
AGAGCATTCAGGTTTTGTTGGGACAAGTTTCTGGTGGCATCCGCTGGACTTTCAGGTGTGTAGGTAGGC
AGAGCTTTCTCCCAGCCAGCAGTTAGTTCACCAGTGGTAATGGATTTGAGTTCTGCAGCTTCCTCGGGG
TACTTCTTCTCATATTCAGCAAACTTGGTATTCCATCCAACTTCAAGAGCAGCACCCTCGGGAACATGA
CGACTCCAATGGCTCTTGACATCTTCAGGC
ACGTGGAACGGCTCATAAGGCCATCCCAAGTTACTCCTGGTGGCCTCTACTTCCTTAGCTCCAAGTGCA
CTTCCATGTACACTGTAACTGTTTGCCTTGTTGGGCGAGCCAAAACCAATGGTTGTAGTCACCTTGATC
ATAGTGGGTTTGTCTGTGACAGCTTTTGCTTCCTTAATAGCAGCACGAATCTCATCATAACCAGTGTTA
CCGTTCTTCACCCAGATTACGTGCCACCCAAGAGCCTCAAAACGGGCACCAACATCCTCAGTGAAAGCG
ATTTCTGTGTCACCATCAATTGAGATGTGGTTGTCATCATAGAAAGCAATCAGCTTTCCAAGTCCCCAG
TGTCCAGCAAGTGAACAAGCTTCTTGTGAAATACCCTCCATCTGGCAACCATCACCGAGAATAACATAT
GTGTAGTGGTCTACAATCTCAGCGTCAGGCTTATTGAAGCGAGCAGCCAAGTGTTTCTCTGCAAGGGCC
AAGCCAACGGCGTTGGCAATACCTTGTCCCAGAGGCCCGGTGGTGACTTCAACACCAGGTGTCTCAAAG
TTTTCAGGGTGTCCAGGGGTTTTGCTTCCCCACTGACGGAAGCTCTTCAAGTCCTCTTCCTTGACAGCA
TCATAGCCAGCTAGATGAAGCAAAGCATACTGAAGCATACAACCATGTCCAGCTGATAGAACAAACCGA
TCCCGATTAAACCAATACGGATTTTCGGG
TTATACCTCATAACCTCATCGTACAGTATATGACCCATCGGAGCACAACCCATGGGCAAACCGGGGTGA
CCCGAATTTGCCTTTTCAACAGCATCAATAGCCAAAAATCGAATAGTGTTTACAGATTTGTCAACAAGG
GCAGTCTCAGTTTTCTGTATAGTTTCGGTTGCAGCCGATGCACGAATCGTCGATGACCGTACGGCGGCG
GCGGAGGGAGGAGTACGGCGGCGGGAGGTGGTGATATTGGGGTTAGATTTAAGGCCGGAAAAAGTGAGA
GAAGAAGGGGAAGTTGAGAAGAAGAGGCAGAGCCATGGCGAGGGACTGAACGAGAGAGGATAGCTTGA
GAGAGAGTGAGAGAAGAAGAAGAAGCCCGGACGCGTGGGTCGAGGGGTAGTCAAGATGCATAATAAATA
ACGGATTGTGTCCGTAATCA FIGURE 7o SEQ ID NO:335 170474 Oryza sativa
CGTTTTAAATAGATCTTACAGTATCACTACTCCATCTCAGTTCGTGTTCTTGTCATTAATTAACTCGAC
CCACGCGTCCGCGATGGTACGCATCATCGGCCCAAGTCCAGCTCAATCCTCCTCACCAACACCAAGACG
ACCACGACCTCCTCGCCCTCGCCGCCGCCCACCGACCATGGCCTCCGCCGCCGCTTCTTCCTCCAAACC
TCCCGTCGTGCTTGGCTGCGGCGCCGTCTCCGCGGACTACCTCGCCACCGTCGCCTCCTTCCCCAACCC
CGACGACAAGATCCGAAGCCTAACGCTCAAGGTCCAGGGAGGCGGCAACACTGGCAATGCCTTGACCGC
CGCTGCTCGTTTGGGCCTTCGCCCAAGGATCATATCCAAGGTATCCAATGACCCACAAGGAAGAAATAT
TCTCAAGGAGCTGCAAGATGATGGGGTCGACACCTCTCATATCCTGGTTGCAGAGGAGGGGAATTCACC
TTTCACCTATATAATTGTTGACAACCAGACGAAAACTCGTACTTGTATTCACACTCCTGGTTATCCTCC
TATGGTCCCTGAAGAGCTCACACAAGAAAACTTGTTTGCCGCTTTAGACGGTGCTGACATTGTATATTT
TGATGTCAGATTGCATGAAACTGCTTTACTAGTTGCTGAAGAGGCAAGCCAAAGAAAACTTCCTATTTT
GATTGATGCCGAACGGAAGAGGGATGGATT
GGACGAGCTTCTCAATTTCGCATCTTATGTTGTATGCTCTGCAAAATTTCCTCAGGCTTGGACAGGAGC
CTCATCAACACCGGTTGCTTTGGTGTCCATGCTTTTAAGATTGCCTAATATCAAGTTTATTATTGTAAC
CCTTGGAGAAAAGGGATGCTTGATGCTTGAAAGAAGCACAACAGATGCTTCTGAGGCAGAGGAAATAGA
TGTAGAGAGTCTTCTGGAATCACTAGAGAAGAAAGAAGTTTTGAGTTCAAGCATGCCAAAATGCATCGC
CTCCAAGTCAAATTTGAGAATAAGTGCAGATGGAATAGGATCCATCAGTGGCAGATTACTTTTAGGCAC
TGCCGAAATTATACCCTCTGAAGAGCTCATAGATACAACTGGTGCGGGTGATGCATTTATCGGAGCAGT
TCTCTACGGTTTATGCTCTGGCATGCCGCCTGAGAAGATGCTGCCTTTTGCAGCTCAAGTGGCTGCTTG
CGGGTGCAGGGGTTTAGGGGCTCGGACTGCTCTTCCCCATCGCACAGATCCCGCCTGGTTGCCTATTG
ACTCGAGGAACTGTAGTGTATCAATCTGTGTTGGATCTGATTGGGATGGATTCATTGGATTGTGGGCGC
CTTTGAAAAATAAGAGATTAAGCATTTGAAATATGGAGTAATAAGAAAGCCGCCTGCAGTTGAAATCGG
TTCCTAAGTTGTATGTAAACAGTGATTGTT
GTTGCATACTGTCAATATACCTTGGCTTGTGTTAATAAGAGAGATTTGTGTGCTGTTGTTGCAAGGCCC
AAAAAAAAAAAAAAGGGCGGCCGCGTCGAGGGGTAGTCAAGATGCATAATAAATAACGG SEQ ID NO:336 175736 Contig A Oryza sativa (Partial sequence from 5'
end of insert)
CGATCGCTTCTCATCGCAAATCGCATCGACTTCGATTCGCTTCGTTTCGTTCTCGCTGTTGATTTGTTC
GTGAGATTTGAATTCTAGCAATGGCTCCTCTCGGTGACGGAGCGGCGGCGGCGGCGGCGGAGCCCA
ACCTGGTGGTGTCGTTCGGGGAGATGCTGATCGACTTCGTCCCCGACGTCTCCGGCGTCTCGCTGGCCG
AGTCCGGCGGCTTCGTCAAGGCTCCCGGCGGCGCCCCCGCCAACGTCGCCTGCGCCATCTCCAAGCTCG
GTGGCTCCTCCGCCTTCGTCGGCAAGTTTGGTGATGATGAGTTCGGGCACATGCTGGTGGACATCCTGA
AGAAGAACGGGGTGAACGCGGAGGGGTGCCTGTTCGACGAGCACGCGCGCACGGCGCTGGCGTTCGTGA
CCTTGAAAAGCAACGGCGAGCGCGAGTTCATGTTCTACCGGAACCCGAGCGCCGACATGCTCCTGACGG
AGGCGGAGCTCAACCTGGACCTGATCCGGCGCGCCAAGATCTTCCACTACGGCTCCATCTCCCTCATCA
CCGAGCCGTGCCGCTCCGCCCACGTCGCCGCCATGCGCGCCGCcaagTCggccggCATCCTCTGCTccT
AcgaccCc SEQ ID NO:337 25080 Contig A Arabidopsis thaliana (Partial sequence
from 5' end of insert)
CAGAATAAGTAAATCCATGGGAGAAAACGCCTAGCTTGCTGCTATGAGAATTTATGACATCTGCCACTT
CTTGGCTCATAAGAATGGCTCCAATCGGCATATATGCTGAAGACAGTGCCTTAGCTAAGGTCACAAGAT
CTGGCTTAATGTTGTATTTGTCACAGCCAAACATTGTCCCGAGCCTTCCAAATGCACATATCACCTCAT
CAGCAATGAACAAGATATCATATTTCTTAACAACAGCTTGAACCTTTTCAAAGTAGGTAGCAGGTGGAG
GTATCACACCCCCAGCACCCATGACTGGTTCAGCTATAAAAGCACCAATAGTTTCTGGTCCTTCTTTGA
TGATTAGATCCTCTAAATTCTTGGCTAATCTGGTTGAGAACTCCTCTTCCGTTTCGCCTGGAAGATGAA
AACGCCAATAATGAGGGCAATCTGTGTGCAACACAAATGGTGCAGGTAAATCAAAATTTTGGTGTAGCG
GGGGAAGGCCGGACAAACTTGCTGATATTAGAGTGGAGCCATGGTACGATTTCTTTCTCGCGATAAACT
TTTTCTTCTCGGGCCTTCCAAGTGCGTTATTGTAATACCAAACCAGCTTGACCTGGGTATCGTTGGCAT
CTGATCCACCGCTTGTAAAAAATGCTTTGGCCATTTTGTTGGCCGTGAACATCTCTAAAAGAACCTTAG
CAAGATCCAG FIGURE 7p SEQ ID NO:338  25057 Contig A Arabidopsis thaliana (Partial sequence
from 5' end of insert)
CCTTCTCTTCTCTAAATAAAAAAAAAAAAAACTGTTTTTTGTGAAAATTAATTGACCAAAAACAAAGAA
ATCTTCTTTCTTCTCTTCTCTTCTTTGTTAATCTTGTTACCCTTCTACCACCACCACCTGTAAAAAAGA
GGTTTTTATCTACCACATAGAGAGACCAGACAAGAACATGTGATTCTTTGGTTAGGTCTCTCAATTCTG
CTGAGCCACAAGCTGATCGAGCTGCATTTGCTCAATCCAAGCTTCTAGCCCAGCATGATCCATTACCGG
TTCAACCGGATTTGGCTGCTTCATCACGTGTTCCCCTGAGGAAGATGTTGCTGCTTTCTCTTTGGCTTC
TGCTGGAGTCTCCTTCACCAGTGACTGGACCCATGACACATCAGGCTCATCACCATCAAACGATGACGA
AGATCTCAACTTACCAAGTGCTTCTGAGCTCATTCCCCAATCCGGTTGACCATTTGAAGATCCCCATTT
TGATGACCATGTGTTGTTGTTTACCGGTGAACCAACGATTGGGCTAGAGTTTGTTCTGAGCTCTCTGGA
GCTAAGGCTACGGAACTGATGTTGCTGCTGCTGCTGCTGTTGCTGTTGTTGTTGCTTCACGCACTG
AGCCAACATGGAAACCCG SEQ ID NO:339  25414 Contig A Arabidopsis thaliana (Partial sequence
from 5' end of insert)
GGAAGAAAAAACGTCTCAAATGTAACCGATAAACCTAATATACCTAAAATTACTTAAAAGGGTTTGCAG
TATTGAAAAATGTTGATGAGTTTTAAAAGGAAAAAAAAAAAGGTAACCTGAATATAGATCAAAACTTGC
CCCGAGGACCCAACTTAAGCGGCTCCTGAGGACCTTTTTTGATGGGAAAAACT SEQ ID NO:340  175736 Contig B Oryza sativa (Partial sequence from 3'
end of insert)
CTCACCCAGGGCGACGCCAACGACGAGAAGAACGTGCTCTCGCTCTGGTTCGACGGCCTCAAGCTCCTC
ATCGTCACCGACGGCGAGAAGGGATGCAGGTACTTCACCAAGGACTTCAAGGGCTCCGTCCCCGGCTTC
TCCGTCAACACCGTCGACACCACCGGCGCCGGCGACGCCTTCGTCGGCTCCCTCCTCGTCAACGTCGCC
AAGGACGACTCCATCTTCCACAACGAGGAGAAGCTGAGGGAGGCGCTCAAGTTCTCGAACGCGTGCGGA
GCCATCTGCACCACCAAGAAGGGTGCCATCCCGGCGCTGCCCACCGTCGCCGTCGCGCAGGAGCTCATC
AGCAAGGCAGCCAACTAGAGCTCCTCGGTTTCGTCGTCGATCGCCGCCATTGGGGGCCTCGGAATTTTA
GGTCGATTTAATTTAGTTGCTGCTTCGTTTTAGACAAGGAAGAGGAGGGGCTTGGGTGTGTTCATGTCT
GTCTTTTGTGTGCTAAGTTAGTTGCTTCCGTGTGAGAACTTTTGGCGTTTATTTTTACTATTATTATTA
ATAAGAAGCTCTTGGATTTGCGGTGGATATTTTGGTCTGAATTTGTGTAATGAGGCAGCTACTTGGCGA
AATTTATTGTGTCATGTCTTTGTTC SEQ ID NO:341  25080 Contig B Arabidopsis thaliana (Partial sequence
from 3' end of insert)
GTTGTCCCATTATTGTTTATTCCTCATTAAAATGTACTTATTTAAAGACTTGTTGTGTGTTAAAAAAAA
AAACAAAGGATCCAAACTTTGAAAATCTAAAAAACATTTTTCATCAACATCATTTTGACTCTGCTTTTC
ACTTCTTGTGCTGAGCCTTGATTTCTTTTACCTTCTCTTCCGTTGCCTTCAATGCTTTCCCATAAATAA
AAATCAACTCATCAATCTCTTCAGGTGAAATAATGAGCGGGGGAAACATCAAAATGCCATCACCTGCAA
CACGGACTAACATCCCGTGCTTCTGGCACTCGGTTCCAAAAAATGCGCCAACACCCCATTCTGGTGGAA
ATGGTTCGTTCGGAAATTTATTGTCTACAAACTCAGTCCCAAAAATCAAACCTGTTCCTCTTGTCTCTC
CAATAATAGGACTACCAGaGGCAAACGCTTTAACTCCATCTTGAAACCTTGGGGCAACTTTGGCGACAT
AATCTGGTAtgttcctctcCTTGtatatcttaAcGcTtcaaTTg SEQ ID NO:342  25057 Contig B Arabidopsis thaliana (Partial sequence
from 3' end of insert)
TTAACAAATAGTCATAACAATAAAATATATAAAAAATAATAATATTAATAACAATAATAATAATGATAA
TGGGAGAAAGAAATCCCTAAAAAAAAATTGAAAATGGGAGAAAGAAAACCAAGAAGGTTTTGTTTCATC
TCCTTTCTTCCCATAAGCCTTTTTCTTGTATTGTTCCCTTCTCTTCTCTAAAT FIGURE 7q SEQ ID NO:343   25414 Contig B Arabidopsis thaliana (Partial sequence
from 3' end of insert)
CGGTAGAGGTAGCGCTGACATAAGTAAGCAAAGAGCCTCCTCCAAGGATCAAGAACTTGAGGAGCAATC
CTCTCTTTGTGAATGGGGCAGCGAATGTCTCAAAGACCTTGCTCTGAAGAGGATTGTAAGGAGAAGGAG
CATCAGAGCCGTATACGTCCCATTGACCTGTTGTGTTACCCAAATCTTCTAAGTCAAAGTAGACACTTT
TGTCTCCATACTTAGCCACCACACCATTAGCCCTATTACACATGAACACACCACCCTCAAGCTAATTTA
ATCCCAACCAAGAGATGAAATTATCAGAATTTAATCCTTTTAAAGCTAATTAATCATCACTATATCTAT
CGTTTAAAACACACTTCAGCCAGCAAAAATCTATTAATATATTTTGAATTTATAGTGTGGTTATAGTGG
CATTTTGATCCTAATTAATGAATAAATGAAAAGTTTTAGTTACCGGATGGATTTGGGTTTAAAGCTCAG
GCGGGAAGGCTTGATGGAGAGCTTAGCTCCGGCGAGTGAGCTGCCGCCGAGTCCTTTTATGGCGGCGGA
TGGTTTCACAGCGGCGACGGTTGCAAGCCCCGCCATGAGCTTCGATCACTATTCTTTTGT Figure 8a. GC/FID Conditions for the Analysis of Tobacco Metabolites in Fraction 1

Column: Chrompack CPSil 8CB, 50 m x 0.32 mm i.d. with 0.25 micron film thickness

Oven
Euilibration Time: 1 minute
Initial Temperature: 50°C     Initial Time: 3.0 minutes

| Ramps: | Rate (°C/min) | Final Temp(°C) | Final Time (min.) |
|---|---|---|---|
| #1 | 30 | 250 | 0.00 |
| #2 | 25 | 340 | 5.50 |
| #3 | 0 | | |

Front and Back Inlet
Mode:            Split                  Initial Temperature:  250°C
Pressure:        15 psig                Split Ratio:          5:1
Split Flow:      23.7 mL/min            Total Flow:           35.2 mL/min
Gas Saver:       Off                    Gas:                  Hydrogen
Mode:            Ramped pressure
Initial Pressure: 15 psig               Initial Time:         0.0 minutes

| Rate (psig/min) | Final Pres. (psig) | Final Time (min.) |
|---|---|---|
| 5 | 40 | 10.0 |
| 10 | 50 | 3.0 |

Post Pressure:       15 psig
Nominal Initial Flow: 4.7 mL/min         Average velocity:     68 cm/sec

Detector (Flame Ionization Detector; FID)
Temperature:     350°C                  Hydrogen Flow:        40.0 mL/min
Air Flow:        400 mL/min             Mode:                 Constant column flow
Makeup Flow:     25.0 mL/min            Makeup Gas Type:      Nitrogen Electrometer:    On                     Lit offset:           2.0
Flame:           On                     Signal Data Rate:     10 Hz
Zero:            0                      Range:                0
Fast Peaks:      Off                    Attenuation:          0

APEX Injector
Injector Mode Program

| | Mode | Front Minutes | Back Minutes |
|---|---|---|---|
| Initial | GC Split | 0.00 | 0.00 |
| 1 | Splitless | 0.20 | 1.25 |
| 2 | Prosep Split | 4.00 | 6.00 |
| 3 | GC Split | 6.00 | 8.00 |

Precolumn Temperature Program

| Rate (C/min) | Target (C) | Front Minutes | Back Minutes |
|---|---|---|---|
| | 50 | 0.20 | 1.25 |
| 300 | 400 | 10.00 | 10.00 |

Figure 8b. GC/FID Conditions for the Analysis of Tobacco Metabolites in Fraction 2

| Liners: | Restek split/splitless single-taper liner 4 mm i.d (borosilicate) without silanized glass wool. | | |
|---|---|---|---|
| Column: | DB23 from J & W, 15 m x 0.25 mm i.d. with 0.15 micron film thickness | | |
| Oven | | | |
| Equilibration Time: | 0.1 minute | | |
| Initial Temperature: | 70°C | Initial Time: | 2.0 minutes |
| Ramps: | Rate (°C/min) | Final Temp(°C) | Final Time (min.) |
| #1 | 25 | 170 | 0.00 |
| #2 | 10 | 220 | 1.00 |
| Dual injection mode: | Start program with front injection. | | |
| Front Inlet | | | |
| Mode: | Splitless | Temperature: | 230°C |
| Pressure: | 12.9 psi | Spliless: NA | |
| Split vent | time: 1.00 min | Flow: 35 mL/min | |
| Gas Saver: | On (5 minutes) | Flow: 20 mL/min | |
| Gas: | Helium | | |
| Mode: | 2 ml/min constant flow | | |
| Total Flow: | 24.5 mL/min | Average velocity: 53 cm/sec | |
| Back Inlet | | | |
| Mode: | Splitless | Temperature: | 230°C |
| Pressure: | 12.9 psi | Spliless: NA | |
| Split vent | time: 2.00 min | Flow: 35 mL/min | |
| Gas Saver: | On (5 minutes) | Flow: 20 mL/min | |
| Gas: | Helium | | |
| Mode: | 2 ml/min constant flow | | |
| Total Flow: | 24.5 mL/min | Average velocity: 53 cm/sec | |
| Detectors (Flame Ionization Detector; FID) | | | |
| Temperature: | 240°C | Hydrogen Flow: | 40.0 mL/min |
| Air Flow: | 400 mL/min | Mode: | Constant column flow |
| Makeup Flow: | 25.0 mL/min | Makeup Gas Type: | Nitrogen |
| Electrometer: | On | Lit offset: | 2.0 |
| Flame: | On | Signal Data Rate: | 10 Hz |
| Zero: | 0 | Range: | 0 |
| Fast Peaks: | Off | Attenuation: | 0 |
| Fraction 3 | | | |

Figure 8c. GC/FID Conditions for the Analysis of Tobacco Metabolites in Fraction 3

| Column: thickness | Chrompack CPSil 8CB, 50 m x 0.32 mm i.d. with 0.25 micron film | | |
|---|---|---|---|
| Oven | | | |
| Euilibration Time: | 1 minute | | |
| Initial Temperature: | 50°C | Initial Time: | 2.0 minutes |

| Ramps: | Rate (°C/min) | Final Temp(°C) | Final Time (min.) |
|---|---|---|---|
| #1 | 30 | 250 | 0.00 |
| #2 | 25 | 325 | 3.00 |
| #3 | 0 | | |

Front and Back Inlet

| Mode: | Split | Initial Temperature: | 290°C |
|---|---|---|---|
| Pressure: | 15 psig | Split Ratio: | 5:1 |
| Split Flow: | 23.7 mL/min | Total Flow: | 35.2 mL/min |
| Gas Saver: | Off | Gas: | Hydrogen |
| Mode: | Ramped pressure | | |
| Initial Pressure: | 15 psig | Initial Time: | 1.0 minutes |

| Rate (psig/min) | Final Pres. (psig) | Final Time (min.) |
|---|---|---|
| 5 | 40 | 10.0 |
| 10 | 50 | 3.0 |

Post Pressure: 15 psig

| Nominal Initial Flow: | 4.7 mL/min | Average velocity: | 68 cm/sec |
|---|---|---|---|

Detector (Flame Ionization Detector; FID)

| Temperature: | 350°C | Hydrogen Flow: | 40.0 mL/min |
|---|---|---|---|
| Air Flow: | 400 mL/min | Mode: | Constant |
| column+makeup Combined Flow: | 20 mL/min | Makeup Flow: | 25.0 mL/min |
| Makeup Gas Type: | Nitrogen | | |
| Electrometer: | On | Lit offset: | 2.0 |
| Flame: | On | Signal Data Rate: | 20 Hz |
| Zero: | 0 | Range: | 0 |
| Fast Peaks: | Off | Attenuation: | 0 |

APEX Injector

Inj Volume: 2.5 ul
Injector Mode Program

| | Mode | Front Minutes | Back Minutes |
|---|---|---|---|
| Initial | GC Split | 0.00 | 0.00 |
| 1 | Splitless | 0.00 | 0.00 |
| 3 | GC Split | 5.00 | 5.00 |

Precolumn Temperature Program

| | Rate (C/min) | Target (C) | Front Minutes | Back Minutes |
|---|---|---|---|---|
| | | 100 | 0.87 | 0.87 |
| | 300 | 325 | 10.00 | 10.00 |

Figure 8d. LC/FLD Parameters for the Analysis of Tobacco Metabolites in Fraction 4

Column: Aminoquant Hypersil ODS 5-μm column (200 mm x 2.1 mm)
Guard Column: Hypersil ODS 5 μm (20 mm x 2.1 mm)
Column Temperature: 45 °C Agilent 1100 Binary Pump Program Mobile Phase A: Aqueous Acetate Buffer pH7.2 containing EDTA (4ug/mL), triethylamine (0.18uL/mL), THF (0.3%) (v:v)
Mobile Phase B: Aqueous Acetate Buffer pH7.2:methanol:acetonitrile (2:4:4) (v:v:v)
Pump Program

| Time (min) | % B | Flow (mL) |
|---|---|---|
| 0.0 | 0 | 0.6 |
| 9.5 | 60 | 0.6 |
| 10 | 100 | 0.6 |
| 10.5 | 100 | 1.1 |
| 13.1 | 100 | 0.6 |
| 14 | 0 | 0.6 |

Agilent 1100 Autosampler Program

Step 1. Draw 5 uL borate buffer
Step 2. Draw 1 uL OPA reagent
Step 3. Draw 0 uL water (Needle Wash)
Step 4. Draw 1 uL sample
Step 5. Mix 7 uL air 5 times
Step 6. Draw 0 uL water (Needle Wash)
Step 7. Draw 1 uL FMOC reagent
Step 8. Draw 0 uL water (Needle Wash)
Step 9. Draw 1 uL borate buffer
Step 10. Mix 9 uL air 3 times
Step 11. Inject Agilent 1100 Fluorescent Detector Time 0.0
    Excitation: 340 nm
    Emission: 450 nm
    PMT Gain: 10
Time 9.2 min
    Excitation: 266 nm
    Emission: 305 nm
    PMT Gain: 9

FIGURE 9a

SEQ ID NO:344   105039   1119810_301901_1
TTTACGCTTTACGACAGTTCCATCGATCAACACCGCAAAGATGGGC
TACGACAAGACCGACCAGCTGGCCATCAACACCATCCGCACTCTCG
CCGTTGATGCCACCTTCGCCGCCAACTCCGGCCACCCCGGTGCGCC
TATGGGCATGGCCCCGGTCTCTCACGTCCTCTTCAACAAGTTCATG
AAGTTCAATCCCAAGAACCCCAAGTGGCTGAACCGTGACCGCTTCG
TCCTCTCCAACGGCCACGGCTGTGTGCTCCAGTACTCTCTGCTGCA
CCTGTTCGGCTACAAGCTCTCCATCGACGACCTCAAGAACTTCCGC
CAGGTCGAATCCATCAACCCCGGTCACCCCGAGTCCCACGACACCG
AGGGCATTGAGGTCACCACTGGTCCCCTCGGCCAGGGTTTCGCCAA
CGCCGTTGGTCTCGCCATTGGTGAGCGCCAGAACGCCGCTACCTTC
AACAAGCCCGGCTACGAGCTTGTCAACAACTACACCTACTGGTTCT
TCGGTGATGGCTGCGCCATGGAGGGTATCGCCTCCG

SEQ ID NO:345   105039   115126_301727_1
GAAGAAATAGTTTTTATTGAAAATATCATGCTACAGTGAACTGCCG
AGTTCGTTTGGTATTGGTTTCCACCATTATCTCCAATCTCAGTTTC
AATATAAAACAAATTTGGTAGACACCAGTAACCAAGGGTAAGT

SEQ ID NO:346   105039   120136_301003_1
CCAATTGAAAATAAGATCTTGGTATCACTCGACCAAATGAAATTAC
AAAACTCAAAGATATGGTTTAAAGTGTACATGGTCAGGAGCATCCA
TAATCCTATTTCTATCCTCATCTTGGATTCATTTTGGCCGCTCCGC
TACTAAAACTGAAGAAAACAAAGGGCAGATGAAGAAATAGTTTTTA
TTGAAAATACCAGGCAACAGTGAACTGCCGAGTCCGTTTGGTATTG
GTTTCCACCATCACCTCCAACCTCAGTGTCAAACTGAAAACAAATT
TGGTAGACACCAGCAACCAAGTGTAAGTAATAAAGCCTAAGAAACT
TGTTTAGCTGCAGCTACAACAGCCTCTGCTGTAATTCCGTACTCCT
GGTATATTTTTCCAGCAGGGGCACTGGCACCCCATCTATCAATTCC
GA*TGGCCTTCCCCTT*TGATCCGACATATTTCTCCCACCCAAATG
TGGATCCAGCTTCAATGCTAACTCTAGCTGTAACAGATGATGGAAG
GACACTTTCCTTGTAGTCGGCTGATTGTTCTTCGAAAAGCctccAA
CAAACaaAGGAAAcaacGGG SEQ ID NO:347   105039   130849_301002_1
gaattcagaagaagaacagaggagaaggaaaaaaaaaatcaatcc
tttattccgataatagcctcaatcatggcagcatCTTCATCCCTTA
CAGTATCACAAGCCCTAGTTGGCAGGAAATCTCTGGTATTAACAC
TTCTTCTCGTTCACAATCATTACCTGGATTCAGTCTAAGTACTTTA
TCAGGAAGAACATTGAAATCTTCATTGATTTCATCGATTGCATCAT
CACGATCTAATCGTGTCAATACACCATCGTTATCGAGATCGTTGGT
GGTTCGTGCTTCAGCTGTTGAGACTTTGGAAAAGACAGATACAGCA
TTAGTTGATAAATCAGTGAATACTATTAGATTTCTAGCAATTGATG
CTGTCGAGAAAGCTAATTCAGGTCATCCTGGTTTACCTATGGGATG
TGCGCCCATGGGTCATATTTTATACGATGAAACCATGAGATATAAC
CCTAAGAACCCTTACTGGTTTAACAGAGATAGATTCGTTCTTTCTG
CTGGTCACGGTTGTATGTTGCAGTATGCTTTGCTTCATCTTGCTGG
TTACGACAGTGTTACGACAGAAGATTTGAAGACTTTCCGTCAGTGG
GGAAGCAAAATTCCTGGTCACCCCGAGAACTTCGAGACTCCTGGTG
TTGAAGTCACTACAGGTCCCCTTGGACAAGGTATTGCTAATGCTGT
TGGATTGGCACTTGCCGAGAAGCACTTGGCTGCCC*GTTTCAACAA
GCCTGACAGCGAGATTGTAGACCATTACACATACTGTATTCTTGGA
GATGGATGTCAAATGGAGGGAATTGCAAATGAAGCTTGTTCGCTAG
CTGGACATTGGGGACTTGGAAAGCTGATTGCTTTCTACGATGACAA
CCACATCTCTATTGATGGTGACACAGAGATTGCTTTCACAGAGAGT FIGURE 9b

```
GTAGATACCCGTTTTGAAGGTCTAGGATGGCACGTAATTTGGGTGA
AGAATGGTAACAATGGTTATGATGAAATTCGTGCTGCCATCAAGGA
AGCAAAGTCTGTCACAGACAAGCCCACTTTGATCAAGGTGACTACC
ACCATTGGTTTTGGTTCTCCAAACAAGGCAAACTCATACGCCGTAC
ACGGTGCTGCATTGGGTTCTAAAGAGGTTGATGCCACAAGGAAGAA
CCTTGACTGGCCATTTGAGCCTTTCCACGTGCCAGAGGATGTTAAG
AGCCATTGGAGCCGCCATACTGCTGAAGGTGCTGCCCTAGAAGCTG
AATGGACAGCTAAATTTGCAGAGTACGAAAAGAAGTACTCAGAGGA
TGCTGCAGAATTTAAGTCCATCATTACTGGTGAATTCCCTGCTGGT
TGGGAGAAGGCTCTTCCTACCTACACTCCGGAGATCCCAGCTGATG
CCACCAGAAACCTATCCCAGACATGCCTTAATGCACTTGCTCCAGT
CCTCCCTGGTCTTATTGGTGGTAGTGCAGATCTCGCTTCCTCCAAC
ATGACCTTGATGAAAATGTTCGGAGATTTCCAAAAGGCCACTCCAG
AAGAGAGGAATGTTCGATTTGGTGTCAGAGAGCATGCTATGGGAGC
CATCTGTAACGGAATTGCTCTCCACAGTCCTGGTTTTGTCCCCTAC
TGTGCTACCTTCTTTGTTTTCACCGATTACATGAGAGGTGCCATGA
GAATTTCAGCTTTATCTGAAGCTGGAGTCATTTACGTCATGACCCA
CGACTCTATTGGTCTTGGAGAGGATGGTCCAACTCATCAGCCCATC
GAACATTTGGCAAGCTTTAGAGCCATGCCTAACATTCTTATGTTCC
GTCCGCTGACGGAAACGAGACTGCCGGGGCATACAAGGTTGCAGT
TGAAAACAGAAAGAGACCCTCAATTCTTGCCCTTTCACGTCAAAAG
CTTGCAAACCTTCCAGGAACCTCCATTGAAGGAGTCGCCAAGGGAG
GTTACACAATATCAGACAACTCTACAGGTAACAAACCAGATGTCAT
CGTGTGTGCTACTGGTTCAGAATTAGAAATTGCTGAAAAGGCCGCT
GGTGAGCCCAGGAAGGAAGGAACTGCAGTTAGGGTTGTTTCATTTG
TTTCCTGGGAATTATATGATGAACAGACCGACGAATACAAGGAGTC
TGTTCTTCCAGCTGCTGTCACTGCTAGAGTTAGTATTGAGGCAGGT
TCAACATTCGGATGGCACAAGATTATCGGAAGCAAAGGAAAGGCTA
TTGGTGTTGACGGTTTCGGAGCAAGTGCGCCTGCACCAATTATATA
CAAAGAGTTTGGCATCACATCAGAGGCCGTTATTGCAGCAGCTAAG
TCAGTTATGTAGATTGTTTTCTTTGTCCCTTTTTCAGCTGAAGCTT
ATTTGTCATTTTGGTTTTTGGATTTCTGCTCTTCCAAATTTAGAAG
TGACACGGGAGGAGAGAGGCCTGTCTTTAAGAGTAATTTGAGTTCA
GAAAACAGCCTCGTGAACGAATTATAATAATAATTAAAAAAAAGA
ACAAAAAAGCTTCCTTGTTTCATATCTTCACATTAACTGGTGAATC
AGAGTTGTCTTATTGAAATTCATGAGAAACAAAATAATGTATTGTC
TTTCACAGTTTCTCTTAAAGCAAAAAAAAAAA
```

SEQ ID NO:348 105039    240432_301314_1
```
gAGCCGCAGCTCGTCCTCTCCATCCCCACACCGATCTACGATGCCA
GTGCCGGTTGCTGCTCGATCGATCGCCTCTGGGACCTCAGCGGCAC
AGCAATCTCCATCTCCGGCTTCGATGCTCTGCCCAGCGAAGCGATC
AGGTGAGCGAATCCATCCGGCAGTCGACAGCTCTAGATTTCGAGGC
GGGGGAGACGCGCGATCGATCCGTGGATGCGGCGAGGCAGCAATCC
AgggaAGAACCGGAGCTAGGGCTTGTCGAGGCATGGGAGGAGGAGC
TGAGGATGATGCTTGGATCCAAGGCCTGGGAGAATGCTAAGGCCAA
TGAAGATTCCCGCGACAAGGAATGGCTACAGGAGCAGATCGATCGG
CGATGCGTGGAAAATATTCGCATGCTTGTGGTGGATGCCGTCAACA
ATGCCCGGCTGGGCATCCAgggctgCCGCTGGGAATGGCCGAGGT
TGGATTCATGCTGTATAGCAAGGTGATGAAGTACAACCCGGCGAAT
CCTGGATGGTTTAACCGCGACCGATTCGTTCTTAGCGCTGGCCATG
GTTGTCTTCTTCAGTATATATGTCTTCATCTAGCTGGCTTCCAATC
TGTCCAGGTGGAAGACTTGAAACGGCTGTGCAAGCTTGGAGGACGA
ACTCCAGGTCATCCAgaGAATGTCAtcactgcgggagttgagGTCT
CaactGGTCC
```

FIGURE 9c

SEQ ID NO:349  105039     8469_300295_1
GCCAAATCAGGTCATCCTGGTCTTCCTATGGGTTGTGCTCCGATGG
CTCACATTTTGTATGATGAGGTCATGAGGTATAACCCCAAGAACCC
TTATTGGTTCAACCGTGACCGATTCGTTCTATCTGCTGGACATGGA
TGTATGTTGCTCTACGCGTTGCTTCATCTTGCCGGCTACGACAGCG
TCCAGGAGGAAGATTTGAAGCAGTTCCGTCAATGGGGAAGCAAGAC
ACCAGGACATCCTGAGAATTTCGAGACTCCTGGAATTGAAGTCACT
ACTGGTCCTCTTGGACAAGGAATCGCTAATGCT

SEQ ID NO:350  105039     271175_200054_1
gtaaagcctggcttcttcttcttctctcactctctctcaagctatc
ctctctcgttcagtccctcgccatggctctgcctCTTCTTCTCAAC
TTTCCCCTTCTTCTCTCACTTTTTCCGGCCTTAAATCTAACCCCAA
TATCACCACCTCCCGCCGCCGTACTCCTCCCTCCGCCGCCGCCGTA
CGGTCATCGACGATTCGTGCATCGGCTGCAACCGAAACTATAGAGA
AAACTGAGACTGCCCTTGTTGACAAATCTGTAAACACTATTCGATT
TTTGGCTATTGATGCTGTTGAAAAGGCAAATTCGGGTCACCCCGGT
TTGCCCATGGGTTGTGCTCCGATGGGTCATATACTGTACGATGAGG
TTATGAGGTATAACCCGAAAAATCCGTATTGGTTTAATCGGGATCG
GTTTGTTCTATCAGCTGGACATGGTTGTATGCTTCAGTATGCTTTG
CTTCATCTAGCTGGCTATGATGCTGTCAAGgAAGAGGACTTGAAGA
GCTTCCGTCAGTGGGGAAGCAAAACCCCTGGACACCCTGAAAACTT
TGAGACACCTGGTGTTGAAGTCACCACCGGGCCTCTGGGACAAGGT
ATTGCCAACGCCGTTGGCTTGGCCCTTGCAGAGAAACACTTGGCTG
CTCGCTTCAATAA*GCCTGACGCTGAGATTGTAGACCACTACACAT
ATGTTATTCTCGGTGATGGTTGCCAGATGGAGGGTATTTCACAAGA
AGCTTGTTCACTTGCTGGACACTGGGGACTTGGAAAGCTGATTGCT
TTCTATGATGACAACCACATCTCAATTGATGGTGACACAGAAATCG
CTTTCACTGAGGATGTTGGTGCCCGTTTTGAGGCTCTTGGGTGGCA
CGTAATCTGGGTGAAGAACGGTAACACTGGTTATGATGAGATTCGT
GCTGCTATTAAGGAAGCAAAAGCTGTCACAGACAAACCCACTATGA
TCAAGGTGACTACAACCATTGGTTTTGGCTCGCCCAACAAGGCAAA
CAGTTACAGTGTACATGGAAGTGCACTTGGAGCTAAGGAAGTAGAG
GCCACCAGGAGTAACTTGGGATGGCC*TTATGAGCCTTTCCACGTG
CCTGAAGATGTCAAGAGCCATTGGAGTCGTCATGTTCCCGAGGGTG
CTGCTCTTGAAGTTGGATGGAATA*CCAAGTTTGCTGAATATGAGA
AGAAGTACCCAGAGGAAGCTGCAGAACTCAAATCCATTACCACTGG
TGAACTACCTGCTGGCTGGGAGAAAGCTCTGCCTACCTACACACCT
GAAAGTCCAGCAGATGCCACCAGAAACCTGTCCCAACAAAACCTGA
ATGCTCTTGCCAAGGTTCTCCCTGGTTTCCTTGGTGGTAGTGCTGA
TCTTGCCTCATCAAACATGACTCTCTTGAAAATGTTTGGTGACTTC
CAAAAG*AACACCCCAGAGGAGCGTAATCTGAGGTTTGGTGTTCGT
GAACATGGTATGGGAGCTATATGTAATGGGATTGCTCTACACAGCC
AAGGCTTGATTCCCTACTGTGCTACTTTCTTTGTGTTCACTGACTA
CATGAGAGGAGCCATGAGAATTTCAGCCTTGTCTGAGGCTGGAGTT
ATTTATGTTATGACCCACGATTCAATTGGTCTagGAGAAGATGGGc
cTACCCATCAACCCATTGAGCACTTggCaaGtttccgTGCAatgcc
caACAttcTGAt SEQ ID NO:351  105039     231061_301074_1
GAGGTTTCGGCCATGGCGTCTCTCCAGTGCAATGCCGGGCGACTCG
CCGCGACGACGCCATCGCTGCCCGACCGCGCCGTCTCCAATGCCCG
GTTCTTCGCCGCATACACAGGTCTGCGCCACGCTTCGCAATCCCTC
GCGAATTCCCCCTCCTCCTCGCCACAGATTCACACGATCAAGCGGC
GGATCCACAGATCCGGCATGGCGTCGGCCACGGCGGTGGTGGAGAC FIGURE 9d GGCCCAGCAGACCGACACCGCGCTGATCGATCTGTCGGTGAATACG
ATCCGGTTCCTGGCCGTGGATGCGGTGGAGAAGGCGAATTCTGGCC
ACCCGGGGCTGCCCATGGGATGTGCCCCAATGTCTCACATTCTCTT
CGACGAGATCATGAAGTTTAATCCCAAAAACCCCTACTGGTTCAAC
AGGGATAGATTCGTTCTTTCGGCTGGCCATGGATGCATGCTCCAGT
ATGCTCTTCTCCACCTCGCTGGATATGATAGCGTCAAGGATGAGGA
TTTGAGGAACTTTCGGCAATGGGGAAGCAAAACCCCTGGTCATCCA
GAGAATTTTG

SEQ ID NO:352 105039    1170742_302040_1
ccgcccacgcgtccgTACCTCTCTTGAAAAACAGGAGAGAGAAAGG
CTAGTAGTAGTAGTTTAAGACCAGGGAAGAGTAAGGCAGGGGAAGA
GAGAGAGTGAGAGATCTGTCTACCCATGGCTTCCTCAACCCTCA
TCCTGCAGCACGTTGTCGCCTGTAAGGCCGCCTCGCCCTCCATGCC
CGCGGTTACCGCCATCGCTGCTGCGCCCAGTCGGAGCTCTTCCCT
TCGGTTGCTAAGCTCTCCTCCGTTGGACGATTGGCCGCCTCCAGA
TCCCCCTCCGGCGCGCCTCTAGCCCTTGCCCGCCCCGGCGTAGGTC
CCTCCGCATCTCTGCCACTGCTGCTGTCGAGGCCGTTGAAACCACT
GATACCGCCTTGGTTGAGAAGTCAATCAACACCATCCGGTTCCTTG
CCATCGACGCTGTCGAGAAGGCCAGCTCTGGCCACCCTGGCCTCCC
CATGGGTTGCGCACCCATGGGCCACATCCTCTATGACGAGGTCATG
CGGTACAACCCAAAGAACCCCTACTGGTTCAACCGCGACCGCTTTG
TCCTCTCTGCAGGCCACGG*ATGCATGCTGCAGTACGCCCTTCTTC
ACCTTGCGGGATACGACAGcGTTAagac

SEQ ID NO:353 170474    172017_300539_1
GATGGTACGCATCATCGGCCCAAGTCCAGCTCAATCCTCCTCACCA
ACACCAAGACGACCACGACCTCCTCGCCCTCGCCGCCGCCCACCGA
CCATGGCCTCCGCCGCCGCTTCTTCCTCCAAACCTCCCGTCGTGCT
TGGCTGCGGCGCCGTCTCCGCGGACTACCTCGCCACCGTCGCCTCC
TTCCCCAACCCCGACGACAAGATCCGAAGCCTAACGCTCAAGGTCC
AGGGAGGCGGCAACACTGGCAATGCCTTGACCGCCGCTGCTCGTTT
GGGCCTTCGCCCAAGGATCATATCCAAGGTATCCAATGACCCACAA
GGAAGAAATATTCTCAAGGAGCTGCAAGATGATGGGGTCGACACCT
CTCATATCCTGGTTGCAGAGGAGGGGAATTCACCTTTCACCTATAT
AATTGTTGACAACCAGACGAAAACTCGTACTTGTATTCACACTCCT
GGTTATCCTCCTATGGTCCCTGAAGAGCTCACACAAGAAAACTTGT
TTGCCGCTTTAGACGGTGCTGACATTGTATATTTTGATGTCAGATT
GCATGAAACTGCTTTACTAGTTGCTGAAGAGGCAAGCCAAAGAAAA
CTTCCTATTTTGATTGATGccGAACGgaagaggGATG

SEQ ID NO:354 170474    172017_301728_1
GGGCCTTGCAACAACAGCACACAAATCTCTCTTATTAACACAAGCC
AAGGTATATTGACAGTATGCAACAACAATCACTGTTTACATACAAC
TTAGGAACCGATTTCAACTGCAGGCGGCTTTCTTATTACTCCATAT
TTCAAATGCTTAATCTCTTATTTTTCAAAGGCGCCCACAATCCAAT
GAATCCATCCCAATCAGATCCAACACAGATTGATACACTACAGTTC
CTCGAGTCAATAGGCAACCAGGCGGGGATCTGTGCGATGGGGAAGA
GCAGTCCGAGCCCCTAAACCCCTGCACCCGCAAGCAGCCACTTGAG
CTGCAAAAGGCAGCATCTTCTCAGGCGGCATGCCAGAGCATAAACC
GTAgaGAACTGCTCCGATAAATGCATCACCCGCACCAGTTGTATCT
ATGAGCTCTTCAGAGGGTATAATTTCGGCAGTGCCTAAAAGTAATC
TGCCACTGATGGATCCTATTCCATCTGCACTTATTCTCAAATTTGA
CTTGGAGGCGATGCATTTTGGCATGCTTGAACTCAAAACTTCTTTC
TTCTCTAGTGAttccaGAAGACTCTCTACATCTAttTccTCTGCCT FIGURE 9e CAgaagCATCTGTTGTGCTTCTTTCaaGCATcaagcatcccttTTC
TccaagggttacaataataaACTTGatattAggCaaTcttaaaagc
atGGAca

SEQ ID NO:355   175736       107582_300379_1
cttttcttctttattgtatagatatatactttacatacacatgatt
ctctctattcatagtcggTATGGCAGCTAACGGCGTTAGTTCTGGT
TTAATTGTGAGCTTCGGCGAGATGTTGATCGATTTCGTGCCGACGG
TCTCCGGTGTATCCCTTGCCGAGGCTCCGGGTTTCTTGAAGGCTCC
CGGAGGTGCACCGGCAAACGTCGCCATCGCAGTGACTAGGCTTGGG
GGAAAGTCGGCGTTCGTCGGGAAACTCGGCGACGATGAGTTCGGCC
ACATGCTCGCCGAGATACTCAAAAAGAACGGCGTTCAAGCGGACGG
GATCAACTTCGACAAGGGAGCGAGAACGGCATTGGCATTCGTGACC
CTACGCGCCGACGGAGAGCGTGAGTTCATGTTCTACAGGAATCCCA
GTGCTGATATGTTGCTCACTCCCGACGAGTTGAATCTTGATGTTAT
TAGATCTGCTAAGGTGTTCCACTACGGTTCGATAAGTTTGATAGTG
GAGCCATGCAGATCAGCACATTTGAAGGCAATGGAAGTGGCAAAGG
AGGCAGGAGCATTGCTCTCTTATGACCCAAACCTCCGTTTGCCGCT
GTggccgTCGGCagaggaggcgaggAAGCAAATCAagagcATCTgg
gA

SEQ ID NO:356   175736       187756_300680_1
TAACTGATTTGAAACAGAGCACACGAAAAGATTTTCTTTTCCTCTG
AACAAAGACATGACACAATAAATTTCGCCAAGTAGCTGCCTCATTA
CACAAATTCAGACCAAAATATCCACCGCAAATCCAAGAGCTTCTTA
TTAATAATAATAGTAAAAATAAACGCCAAAAGTTCTCACACGGAAG
CAACTAACTTAGCACACAAAAGACAGACATGAACACACCCAAGCCC
CTCCTCTTCCTTGTCTAAAACGAAGCAGCAACTAAATTAAATCGAC
CTAAAATTCCGAGGCCCCCAATGGCGGCGATCGACGACGAAACCGA
GGAGCTCTAGTTGGCTGCCTTGCTGATGAGCTCCTGCGCGACGGCG
ACGGTGGGCAGCGCCGGGATGGCACCCTTCTTGGTGGTGCAGATGG
CTCCGCACGCGTTCGAGAACTTGAGCGCCTCCCTCAGCTTCTCCTC
gttGTGGAAGATGGAGtCgtcCTTGgcgACGttgACGAGGAGGGAG
CCGACgAAGGCGTCGCCGGCGCCGGTGGTGTCGACGGTGTTGACGG
AgaagCCGGGAcGGAGCCCTTGAAGTCCTTGGTGAAgtaCCTgca
TCCCTTCTCGCCgtcG

SEQ ID NO:357   175736       250145_301599_1
GATATGGCGAGGGATACGAGCTCCAATCTGGTGGTGTGTTTCGGCG
AGATGCTTATAGACTTTGTTCCCACAGTCGGGGGTGTCTCCCTGGC
GGAGGCTCCGGCGTTTAAGAAAGCTCCCGGTGGAGCTCCGGCAAAT
GTTGCGGTCGGGATCTCTCGCCTTGATGGAAACTCCGCATTCATCG
GTAAGCTTGGTGAGGATGAATTCGGCTTCATGCTTCTGGACATCCT
GAAGGACAACAATGTAGAGAGCAAAGGCATGCGTTTTGATCCCGGT
GCCCGTACTGCTCTCGCGTTTGTGACGCTCCGCAAGGACGGCGAGC
GTGAGTTTATGTTTTACCGCAATCCAAGTGCCGACATGCTGCTAAA
GCCGGACGAACTGGACGAAGACCTTATCAAACAGGCCTCCATTTTC
CACTACGGTTCCATCAGCCTCATCGCAGAGCCCTGCAGATCGGCCC
ACTTGGCCGCGATGAAAATCGCCAGAGAAGCCGGGGCGATCCTTTC
GTATGATCCCAACTTGAGGCTTCCATTGTGGAGCTCGGCAGAGGCA
GCCCGGAGCGGCATCAAAAGCATCTGGAACGAaGCCGACATCATCA
agAtAAGTGAggAgGaGatcACTTTccTGACTGAAggAggCGATgc
ataCaGCGATg FIGURE 9f

SEQ ID NO:358   175736      190868_300736_1
CCCCCGATCGCTTCTCATCGCAAATCGCATCGACTTCGATTCGCTT
CGTTTCGTTCTCGCTGTTGATTTGTTCGTGAGATTTGAATTCTAGC
AATGGCTCCTCTCGGTGACGGAGCGGCGGCGGCGGCGGCGGCGGAG
CCCAACCTGGTGGTGTCGTTCGGGGAGATGCTGATCGACTTCGTCC
CCGACGTCGCCGGCGTCTCGCTGGCCGAGTCCGGCGGCTTCGTCAA
GGCTCCCGGCGGCGCCCCGCCAACGTCGCCTGCGCCATCTCCAAG
CTCGGTGGCTCCTCCGCCTTCGTCGGCAAGTTTGGTGATGATGAGT
TCGGGCACATGCTGGTGGACATCCTGAAGAAGAACGGGGTGAACGC
GGAGGGGTGCCTGTTCGACGAGCACGCGCGCACGGCGCTGGCGTTC
GTGACCTTGAAAAGCAACGGCGAGCGCGAGTTCATGTTCTACCGGA
ACCCGAGCGCCGACATGCTCCTGACGGAGGCGGAGCTCAACCTGGA
CCTGATCCGGCGCGCCAAGATCTTCCACTACGGCTCCATCTCCCTC
ATCACCGAGCCGTGCCGCTCCGCCCACGTCGCCGCCAtGcgcgCCG
ccaaGTCggccGGCAT

SEQ ID NO:359   175736      268759_200053_1
gttgtttccctgttatccttgaccgatccatgaaaagcagcttcaa
gctatccaagagttcttcttctgataagctcaatAAAAGCAAGAGC
TTTATCTGTTCACCAACATCTCTATCAACGAAGAAAAGGGAGCAGG
AAAACAATCACCTGGTTGTATGTTTCGGGGAGTTGTTGATTGACTT
CGTTCCTACTGTATCTGGAGTTTCACTTGCAGAAGCGCCTGGATTT
GAGAAAGCTCCTGGTGGAGCTCCAGCTAACGTTGCAGTTGGTATAG
CAAGATTAGGAGGTTCTTCCGCCTTTATTGGCAAGGTGGGTGCAGA
TGAATTTGGTTATATGTTATCTGATATATTAAAACAGAACCATGTC
GACAATTCTGGCATGCGTTTCGATACCCATGCAAGGACAGCATTAG
CATTTGTCACTTTGAGAGCAGATGGCGAGAGAGAATTCATGTTTTT
CCGCAATCCAAGTGCTGATATGCTTCTTACAAAGGAAGAGCTGGAC
AAAGATCTCATTCAGAAGGCAAGAATATTTCACTATGGGTCAATCT
CTTTAATCGCGGAACCGTGTAGGTCAGCTCATCTTGCAGCCATGGA
GATTGCCAAAAAGCTGGCTGCATTCTCTCTTATGACCCAAATCTA
AGGTTGCCCTTATGGCCATCCGCAGATGCTGCTCGTAAAGGCATCT
TGAGCATTTGGGACCAAGCCGACGTTATTAAGGTAAGCGAAGACGA
AATCACATTCTTGACAGACGGTgaagacgccctAcgatg

SEQ ID NO:360   175736      272621_200131_1
TCCGCTCTACTGGAACAGAACAACTGCTTCAATTCTTCCGAAAATT
AGGGTTTATTGTCTACAAATTCCATGTTACCAGCGATTACTCCAAC
ATTTCACATCGTACTTTCCCTTTTAGTTGCTGAAATCTAACGCCTG
ATGTAACTGTATTAGGGTCTCAATTTGAAATTCACTATCTCAACTA
GTTTCTCAGATCAAACACTATATCCCTTTCTACCATTCTTTAAAAC
TTCATACAGATATGGCTCTTCTTCATTCTCCTACTTTCTGCTTCAG
TGGAGTTTCCACTTCAAGTCAAGCTTCTAGAAGTTTCCCTGCCCCT
AGAAGATGCACTGTGAAACCAGCACCTTTTCTCTCCCAGTCTCTTC
CCTTCTTTCCTCGATGCAAACTTCAAGGAAGAGCATTGCCAAGCGA
CAATGGGCCATTAGAGAAGGATGAATCTTCCCTTGTTGTATGCTTT
GGAGAAATGCTCATTGATTTTGTTCCGACCACAAGTGGGCTGTCAT
TAGCTGAAGCACCTGCATTTAAAAAGGCTCCTGGTGGTGCTCCAGC
TAATGTTGCTGTTGGCATTTCCCGTCTTGGTGGTTCCTCAGCTTTC
ATTGGGAAGGTTGGTgAagacgaatTTGgttacATGCttGCTGATA
TTTTg FIGURE 9g SEQ ID NO:361  182206   142388_300434_1
ccccatgacattgcttaagatgttcggtgacttccaaagggatacg
cctgaggagcgcaatgtccgatttggagtcagggAGCATGGAATGG
GcgcCATTTGCAACGGCATTGCTCTGCACAGCCCAGGACTCATTCC
ATACTGGGCTACTTTCTTTGTTTTCACTGATTACATGAGAGCTGCC
ATGAGGATCTCAGCCTTgtgtgAAGCCGGAGTTATCTATGTTATGA
CCCATGACTCTATTGGTCTTGGagaagaTGGTCCAACCCATCAGCC
CATTGAGCACTTGgtgAGCTTCCgtgCGATGCCCAACATTCTGATG
CTTCGTCCTGCTGATGGTAACGAGACTGCTGGGGCATACAAAATCG
CGgtCCTCAACAGGAAGAGGCCATCCGTCCTTGCTCTCTCCAGGCA
AAAGCTTGCTCAGCTGCCTGGTACCTCGATTGAGGGTGTTGAGAAG
GGTGGGTACATCGTCTCTGACAACTCAACTGGCAACAAGCCTGACT
TCATTGTGATGAGCACTGGCTCTGAACTAGAGATTGTCGCCAAGGC
TGCTGATGAGTTGAGGAAGGAGGGGAAGACTGTCCGTGTCGTGTCA
TTTGTTTGCTGGGAGCTTTTCGATGAACAGTCGGCTGAGTACAAGG
AGAGTGTTCTCCCTGAGGCTGTTACTGCAAGAGTCAGCCTTGAAGC
AGGGTCTACTCTTGGATGGCAGAAGTACGTCGGAAGCAAAGGCAAG
GCTATTGGCATCGACAAATTCGGTGCAAGTGCTCCTGCTGGAAAGA
TCTACCAGGAGTATGGCATCACCGCGGAGAACGTCATCGCAACAGC
AAAGAGCCTGTAAGATTCAAACCGCGCGTTTTGAGTTTTTGTCATC
GTTGATGCCAAGGAACAGTATACATGAAGCCATGAAGGTCTTGTGC
CCAAAGCTTGGAATAATGAAGGGAGAGGGATGCCTGCATTGGAGCG
TGAGTGGTATTTTAGGCCTGTAATAAGCACTGCTTTTCCATTTACG
TTTGTTTTGTTGGATCACTCCTTagaTGATTCATCAAGTTGAGCCT
GATTCAATTGGGGACTggtTTTGGTAATATTTACATTTGACTAtAG
TccagCTACAATATTccg SEQ ID NO:362  182206   233046_301275_1
GAAACGGAATGGGAGCAATCGCGAACGGCATTGCTCACCACGGCAG
CGGACTCATCCCCTACTGCGCGACGTTCTTCGTCTTCACCGACTAC
ATGCGCGGAGCCATCAGGCTGTCAGCACTGAGCGAAGCCGGGGTCA
TCTACGTCATGACTCACGACTCCATCGGCCTCGGCGAGGATGGCCC
GACTCACCAGCCGATCGAGCACCTCGCCAGCTTCAGAGCGATGCCG
AACATCTTCATGCTGCGGCCCGCCGACGGCAACGAGACCGCCGGTT
CCTACAAAGTTGCAGTGCTCAACAGGACGACTCCATCGATCCTGGC
TCTCTCCAGGCAAAAGCTTCCGCAGCTCGCCGGCTCCTCGATCGAC
AGCGTCTCCAAAGGCGCGTACGTCCTCAGCGACAACTCGTCGGCAA
ACAAGCCCGACCTCATCTTGATCGGCACCGGGTCCGAGGTGGAGAT
CGCTGTCAAGGCCGCGGACGTTCTCCGGAAAGAAGGCAAGTCCGTC
CGGGTGGTGTCGTTCCCGTGCTGGGAGCTGTTCGATCAGCAAAGCG
ACGAGTACAAGGAGAGCGTCTTCCCGAGCGGTGTGACTGCCCGAGT
C SEQ ID NO:363  182206   30310_301726_1
agttgaaatctattatctcaggtgaattgcccgttggttgggagaa
ggcacttcctacatatacaccagactctccgggtGATGCCACCAGA
AACCTGTCTCAGCAATGTCTTAACGCACTTGCGAAAGCTGTGCCTG
GTTTTCTTGGTGGGAGTGCTGACCTTGCATCTTCCAACATGACAAT
GCTTAAAGCATTCGGCAACTTCCAAAAAGCCACACCTGAAGAAAGA
AACCTTAGATTTGGTGTCAGGGAACATGGTATGGGAGCTATCTGCA
ACGGCATTGCCCTTCACAGCCCGGTTTTATCCCTTACTGCGCAAC
TTTCTTTGTGTTTACTGACTATATGAGAGCTGCAATGAGAATCTCG
GCTTTGTCTGAAGCTGGTGTTATATACGTTATGACCCATGACTCCA
TTGGTCTTGGAGAAGATGGACCAACCCACCAACCCATCGAACACTT
ATCCAGTTTCCGTGCCATGCCCAATATTATGATGTTCCGTCCAGCT FIGURE 9h GATGGGAACGAAACAGCCGGTGCATACAAAATCGCTGTCACAAAAC
GTAAGACACCTTCTGTCTTAGCCTTATCTAGACAAAAGCTGCCTCA
ACTTCCAGGAACATCTATTGAGAGCGTCGAGAAAGGTGGATACACC
ATTTCttgaCAACTCAACCGGTAACAAACCCGATGTGATCTTGATC
GGAACTGgatcagaGCTagAGATTGctgctcaa

SEQ ID NO:364 182206    232933_301085_1
attctacgttataccgatggtttacgaggaattcaagaaaaaggtg
aagaaagcagaatgcgaagaagaggaatggaagaTCGAGTTTGCAA
AGTACGAGGAGAAGTTCCCCGACGAAGCCAACGAATTCAAGCAACT
TAAAAGTTCTCAGGGATGGGAAAAAGTCTTGCCAACATGGTCGCAA
TCAGACCCTGttGATGCTACACGGGGCTACTCGGAGAAATGCCTGA
ACGCGTTATCTACTGCACTTCCCGCACTGATCGGTGGCAGCGCAGA
CTTAGCATCGTCAAACAAGGCCTATCTCAAAGATCACGACGACTTC
CAGCATAAGACACCATGGGGAAGAAACATCCGCTACGGTGTTCGGG
AGCACGCAATGGCCGCGATCTCCAACGGCATTTCCCTCCATGGCAG
CGGCCTCATCCCGTTCGCGGCAACGTTCATGACATTCAGCGACTAC
ATGAATCACGCGATGAGACTGTCGGCTCTCAGCGAaGCCGGCGTCA
TCTACATTTGCACGCACGACTCGATCGGGCTGGGTGAGGACGGCCC
GACGCATCAACCTGTGGAACATCTCGCAGGACTTCGAGCTATTCCA
AACTTATATCTTCTACGTCCGGCCGACGGCAATGAAACAAGCGGTG
CATACAAGGTGGCGGTGAAGAGACGAGaTcaaggCCCGACGGTCAT
CTCCTTGTCGCGGCAGAAAGTTCAGGCTCACGTCGCAGGAACTTCG
GCAGACAAAGTCGaGAAGGGAGGATACATCGTGAGTGACAATTcGT
CTGGCgaaccgGAGCTGATTATCATCGGGACCGGGTCGGAGCtgtg
cctGTGCGagggagcagCaGagaAGCTg

SEQ ID NO:365 21604    109363_300045_1
GAACTTCTTAATACAAAGATATGCTGGTCATAAACCAAGGGGGGAT
GCAATTGAAGCAGCTCATGATAAAATAATAATGCAGAAATTCTATG
ATAGGAAAAACCCAAAAATTGACTTTAAGAAGAAAGTCAGGGACAT
AAAACAATCTCGTGTTATGCAGGCTGTCACTAGCAGGTTCAGAACA
CCAGCTACAAATTTCATTGTGAAAACTTCTATCGCTTTCATAGTCC
TTGGAGCTCTCACAGTTCTCTTTCCTACTGAAGAAGGTCCAACGCT
TCAAGTTGCCATTTCCCTGATCACCGCCATATATTTCATTCATGAT
CGGTTAAAGAGCAAACTTCGAGCTTTTCTATATGGAACTGGTGCTT
TTATTTTCTCTTGGCTTTTGGGGACATTCTTGATGGTGTCTGTGAT
TCCTCCTATACTTAAAGGGCCAACGAGTTTGGAGGTGACAACTTCG
TTGATTACGTATGTACTTTTGTGGGTTTCTTCTACTTACCTCATAT
AGGACTGTGGCATCATCTCAATTTTGGCAGGGAAGTACATTAGTTT
CTCGATACTAAAATAGAGGAAGATTATTGAAACTCAAGCCGAGTCC
CATGATTATCTGTTACAGCTTTTATTGCTA

SEQ ID NO:366 21604    12292_300278_1
GAAGCACGAACGGCGTCGGGTTAGTCCGACGGAGGAACCATGTCCT
CGTCTCTTCTTCTCTCCGGTTCTACTGTATCTTCTTCGTTTATCGC
TCCATCTAAGCCTTCTCTCGTACGAAATTCCAGTAAGACATCACTG
TTACCATTTCGTAATGTTTCGAGAAGCTTCAAAACCGTCAAGTGCA
CCGTTGATTCTTCATATGGAGGCAATGTTCCCACGTTCCCTCGGAC
GAGAGTTTGGGACCCGTACAAACGTCTAGGAGTTAGTCCATATGCT
TCCGAGGAAGAAATCTGGGCCTCTCGTAACTTTCTTTTACAGCAGT
ACGCTGGACATGAAAGAAGCGAAGAGTCTATAGAAGGAGCCTTTGA
GAAGCTTCTCATGTCTAGTTTTATCAGAAGGAAGAAGACTAAAATC
AATCTTAAATCAAAGTTGAAGAAGAAAGTTGAGGAATCTCCTCCGT
GGCTCAAAGCTCTTCTCGATTTCGTTGAAATGCCTCCCATGGACAC

FIGURE 9i

TATTTTCAGAAGACTTTTCCTCTTTGCCTTCATGGGTGGTTGGAGT
ATCATGAACTCTGCAGAAGGCGGTCCTGCGTTTCAGGTGGCGGTAT
CATTGGCTGCGTGCGTATATTTTCTGAATGAGAAGACAAAGAGCTT
GGGGAGAGCTTGCTTAATCGGAATTGGAGCTTTAGTTGCCGGGTGG
TTCTGCGGTTCGTTAATCATTCCCATGATTCCGACGTTTCTCATTC
AGCCTACATGGACACTCGAGCTCCTAACATCACTGGTCGCTTATGT
GTTTTTGTTTCTTTCTTGTACTTTCCTCAAGTAAGTTACGTTGTGG
TTTTATCCAAACTCTTTTTGTTCTTTTCGCCCAGACATTTACAGAA
CCTTTCGGAAAAATTAGTGAAAGTTGTT

SEQ ID NO:367 21604        142824_300444_1
ttagcaaaaagttgctcctttgcaatctttcaagttccacctaacc
ggagacggagtgaaccatctcggccggcacggccTTTATGGAAAAG
TTTTCTCCACAATAAGCTCGATTTTCAGAAATCAGTACAAAATCTA
GGGTTCTTATTGGAGGGGACAAATTTCATGGCGACAACTCTCATCT
CGAAACTTACCCTTTCCTCTGCTTTCCTCGGCCAACAATTTTCGAG
TAGAGGAAATTCAATGAGGTcGGCACCCGCTGGTtTgtTTCTCAGG
GGCCCAAGATGTGCGGCAACGGATAcgcCTTATGGGGGTAATATTC
CACAGTTTCCTCGAGTgAaTgttTGGGATCCCTACAAACGCCTTGG
AATAAGTCGCGATGCTTCTGAGGAaGAAGTTTGGAGCTCAcgcaaC
TTTTTgttAAACcagtaTTATAATCACGAGAGAAgtgcagAATCAA
TTGAAGCTGCCTTTGAGAAGATATTAATGGCAAGCTTCATAAATAG
AAAGAAGACAAAGATTAACTTGAAAACAAGGCTAAAAAAGAAAGTT
GAGGAATCTCCCCCTTGGGTTCAGAACCTCCTCAGTTTTGTGGAAC
TTCCACCGCCTGTAATTATTTTGAGGAGATTATTCCTCTTTGGATT
CATGGCTTGCTGGAGTGTGATGAACTCTACTGAAGCTGGACCTGCA
TTCCAGGTAGCTATATCTTTTGGAGCTTGTGTGTACTTCCTTAATG
ACAAGACAAAGAGCTTAGGAAGAGCTGCTCTTATAGGGTTTGGAGC
CCTAGTGGCTGGTTGGTTTTGTGGTTCACTGTTGGTTCCCATGATC
CCTCCGAATCTGTTGCACCCAACTTGGAGTCTTGAACTCTTAACAT
CTCTCTTTATTTATGTTTCcTTgtTTCTGGGcTgtaCTTTTCTCAA
ATGAAGCTCTACAGaaccTGTTTTGCTGTagcagTtTTTACATgtc
gcATCCTGATtaattcaTGgtgttccttcactaTTTTGTACCTTCa
agAtT

SEQ ID NO:368 23242        52317_300089_1
TTTTTAAACCAAATAGATAGGATATATTTATTCAAATCAGAAGcac
ATTAGGGAACACAAGAACAGAGACAATTCAACACATGTAAATGCAT
AAAATCAAACAAACTGAAACACAAAGACACTTCAAACGAAAGAACT
GAGATTGAAGGAACCAATCATGTTTGCGAGAGCAGAACTCATATCT
AGCTCAAGCTGAAGCTTCTGAAGCTCAAGCTGTTGCCTCAAAACTG
GATCTTCCACTTGCTCTGTTATTGCAGCTACTTGTTCCGTCTGCTC
AGTCTCCAAACCCTGAACAGGAACAGATTCAGCAGTCGGTGTCTTT
CCTTCATCACTCGCCCCACAGTTCTCAGCAGAAGCAGCCACTGGAT
TGGGCTTATTCACAGCACATGAAGCATGAATATGATAGTTACAAGC
ATAACAGTTGTAAGACCAAAACCTACCATCCATAGTCATATTACAA
AGATTGCAAACAAGCTGATTCCCGAAACCAAACTGAGTAAAAGACA
TAGGAGGAGTACTGTTGTAGACAAGAAGAAGACTATGCATAGGATG
AGACTCATGAACCAAGACCTGAGGCAGGTGAGCGCATTGAACATGA
AGGTCAAAGTCACACAAAGGACAACAGTAAGAGAACCCTTTACCTC
CAGTGCAGCCACAGGCTCTGC FIGURE 9j

SEQ ID NO:369 23869    23558_300254_1
gTCGACCCACGCGTCCGCTCTTTCCTTCTCTCACCGCGAGAGTAA
CCGAGAGACATGATTCTGATAAACTCTAATTCTCCGACGCTAATC
TCAGCCGTTAGATTCGTGGGCTCATCTCCGTTCACCACTCGGGGG
CTTTCTCAGTCCACTGTCTCAATCTCTAGAAACAAAAGCTTCTTC
TTCCACTTCACCGAGACGAAGGAGAAGAACGCAAGAAGAGATTAT
TTGAGAGTATCAATCGTGTGTGACGCAGGAGGGATGTTTCCGGTG
GATCCATGGGCTCCAACCATTGATTCACAGAGCATAGCATCACAA
CTCTTCGCTGTATCTCTGTTTCCTTACATTGGCTTTCTCTATTTC
CTCACTAAATCCAAATCAGCTCCAAAACTCACACTT*TTCGGTTT
CTACTTCTTGCTTGCCTTCGTTGGAGCTACAATTCCAGCTGGGAT
TTATGCTAAGGTGCATTATGGAACATCGTTGTCGAATGTTGATTG
GTTACACGGAGGAGCTGAATCACTTCTTGCTCTTACCAATTTGTT
TATCGTGTTGGGTCTTAGACAAGCTCTGAGGAAGTCTCAAGATGA
TGATGATGATAAACTTGGTAATGATGATGAAGTTCCAACAACTCA
AGAACAAGGGAAATCTTCAGTGTAGTAAAACAAATGTAAATTTTT
TAATTATGGAGTTTCACTTGTTTTT

SEQ ID NO:370 23869    254343_301632_1
ATTAAAAGATGATGATGATGGTGCAAGCATGTCCTCTCTCTCACA
ACTCTCTCCCAACTCCATCACACTTGCAATCTCTCTCTCCCATGC
TATCAAGCAAGGGAGGGAGGGGTAAGGGAGCAAAAGCATAGTGA
AGGCTTCCTTATTGTGGGAGCCCAATTCAACATCAATCCTCCTAG
AGAGCATAGCACACCCACACTCTTGGAGTGCCCTCCTCCCTGTGA
TGGTGATAGACCCTTGGTCCCCCAACATAAAGGCAGATAGCATAG
CCTCTCAGCTCTTTGCAGCCTCCCTCTTCCCCTACCTGGGCTTCC
TTTACCACTTGACAAAGTCAAAGACTTCCCCCAACCTCACCCTCT
TTGGCTTCTACTTCTTGCTTGTCTTTGTGGCTGCCACTATTCCTG
CCGGCATTTATGCAAAAGTAAAGTATGGAACATCCTTAGCAAATG
TGGATTGGCTTCATGGAGGCGCTGAGTCTTTTCTTACCCTTACAA
ATCTTTTCATTGTAATTGGATTGAGGAAAGCTTTACGCGGCGATG
ATAGTGTTCCAAAATCTTTCTCAGCAAAGGACGGTGAAACCATAG
AAGAGAGCTCACCCCTTTCAAATAAATGTATGGCTGATGAGG

SEQ ID NO:371 25008    9049_300296_1
TGACTGATTACTACTACTTGTACTAACTCTAATACATTTACAAAA
CAAGTCCTCCTTTTCCCCAAGTATACAGATAAAGATTTACCAGAA
CCGGTTTTCCGCCTTCATCTCACATGGAAATCGTAAGGAGAAGAC
GCATACACTTGATCTGGAACCACTAGTGGTAACTTCTCAATGTAC
ATAAACAATCGTTTCTGGTTCTCTCTAGCGATTGCAGTGAGATTC
ACTGTATCGTTTTGGTCCAAAAACATCCAGAGATCACCTGAATCT
ACTCTTTTAAGGCTGTCTCTGcaGAACGGGCATGACtgtgATCTC
CCTCGCcAATCGCGgtAACACTTGATGCATAAAGAATGAGTAcAg
ttTGGTAGCACCACCTTGctgttCATCtccATACagaTTCCACAT
TCTTCTtccCtctCGATCTCAATCTCCGaCATTTCGCTCTCATCc
TtCTTTCtgtaTcgnatCTTGCATAcctCTTTTgttTgctgtcA
TCTATGTCtgtaACACCCCTTTGtagttgtgacaaAGAtggtaat
ATCACAGCttggaaCTCTCTTATACtggcttTtCtTtCGtaaaCc
GaCat

SEQ ID NO:372 25009    154949_200017_1
AGAGAGTTTATGGCAAATGGCCTTCGAGTGTGGATATTCAGCGGC
GACACTGATGGAAGAGTGCCTGTTACTTCAACCAAGAATTCTATT
AAGATAATGAAGCTTCCTATCAAAACTGCGTGGCACCCCTGGTAT
CTCAGTGCAGAGGTTGGTGGATATACACAATCATATAAAGGAGAT

FIGURE 9k

ATGACATTTGCAACCGTACGAGGGGCAGGACATCAAGTACCAAGT
TATGAAGCAGCTAGATCCCTTTCACTTGTCATGCATTTTCTTGCT
GGAACTGAACTTCCCGATAAACACACTTAACTACTTTTCTAGTCA
ATATCTGAACCCTTAAGATCCTTCATTCGTTTCATGCATTTATGG
GTTCAGGTTTTAACGTAATGTGGCATTCCTTCTTCTATTTTTCAT
TTCTCGAAATAATCTCCGGTATTTAATTTTTAGTAGAATTAAATT
TTTCTATAACAATTATTTTTTATAATATTACTTTATTATGACAGC
CGAAATT

SEQ ID NO:373 25011      25006_300100_-1
CCCACGCGTCCGATTAGGAATAAGGCGCGTGCTTTCCAGCTTCTG
CGAGCAAAACTGTATGAAATAAAAGTAAGGGAACAACAAGAGAAG
ATAAGGAATGAAAGGAAATCTCAGGTTGGGACTGGAGCTCGTTCA
GAAAAGATAAGAACATACAATTATAAGGACAGTAGAGTGACTGAT
CATAGGCTAAAGATGAACTTTGCGCTTACAACATTTCTTGACGGT
GCTTTAGAGGACGCAGTGCAGGCTTGTGCTGCTTTGGAGCAAAAG
GAACTCATGGAAGAACTCTCCGAGTCTGTAGCTGCTTCTTCTGCT
ACTTCTGGATAAATCCTCAAACTATACTCCAAGGAAAACTTTGTA
GTTGTACACATCATAATTATAAGACTTTTATTCATTCAAAA

SEQ ID NO:374 25015      55674_300134_1
GACGCGTGTTGGGAATCCAACTTACCAATTGCAATGGCGTCAATG
ACCATGACATCTTGATTTCTCCCTACCGTCTCAAACCTTCCGGCA
AACATCTCCAGCAACAGCAGACGAAGCCTCACGGTGGTCAAAGCC
TTCGGGAGTGAAAACACAACCAGCTTGGAGAACAAGAAGCAAGAA
CAGAGCATGAACATGAGGAGGGATCTTGTCTTCACAGCTGCAGCT
GCAGCTGTGTGCTCCTTACCTAAGGTGGCAATGGCAGACGATGAG
CCAAAGAGAGGAACAGAAGCTGCCAAGAAGAAGTATGCTCCAGTC
TGTGTCACAATGCC

SEQ ID NO:375 25026      25608_300080_1
tttttttagatattaAAGAGTACAACAATGTTGATTAACTTAGTT
CCTCTGTACATTGAAGATTCCAAATTTGTTCATGGAGCTACAACG
GTTCAACAATAATTCAAGCTCAAAAACCAAGAACTCTAAGATGAA
ACACACTCACAGACAGACATGAAAGTGATGGAAGATAGATAGGTA
TGAGATCATAAGTCTGTCTTCACTCTTTAGTTGAAGGTTTGGACA
ATAGTGTTGTGCCATGGGTCAGACAAGTGCTGCAACAGATTCTCA
AATGGTCCTTTTCCAGTCACATTGTGTTGAACCACAAACCCTAAG
AATGCCAACATCGCCAACCTCCCGTTTGCTAGCTCTTTCTCCTTG
GCCTCTTGCGTAGGAGCAAAGTTAAGCGGGTTAAAGATTCCACCA
GGGTAACCAACTTCACCCTTAGGTAAGCTGTATTGCTTAAAGATA
GGGTCTTGGTTCACACTTCCTGGGTCTTGATGTCTTGCCACCGT
CTGATCTCAACGTAATGAAACAATATGAACTCGATCACGAACAAT
GTCGACGACGATGCAAAATACTGCtCTTTCCCAGCATCGTACCAC
TCAGGAACATTTATGATTCCGATCTTGgtgAAAACTTCCGGCAAA
AGCATCcCAGCGACACCGAGCATAGCCCATCGTCCGTTGACCagC
tctgcCTGGAcgAACCATTTCAAgTtCTCTGGATCctcTgcTaga
cccaACGGGTCAAACCCATTGTCACCGgCa SEQ ID NO:376 25057      16278_300230_1
CCCACGCGTCCGCGGGTTTCCATGTTGGCTCAGTGCGTGAAGCAA
CAACAACAGCAACAGCAGCAGCAGCAGCAACATCAGTTCCGT
AGCCTTAGCTCCAGAGAGCTCAGAACAAACTCTAGCCCAATCGTT
GGTTCACCGGTAAACAACAACACATGGTCATCAAAATGGGGATCT
TCAAATGGTCAACCGGATTGGGGAATGAGCTCAGAAGCACTTGGT

FIGURE 91

AAGTTGAGATCTTCGTCATCGTTTGATGGTGATGAGCCTGATGTG
TCATGGGTCCAGTCACTGGTGAAGGAGACTCCAGCAGAAGCCAAA
GAGAAAGCAGCAACATCTTCCTCAGGGGAACACGTGATGAAGCA

SEQ ID NO:377 25057        9038_300296_1
ACAAATAGTCATAACAATAAAATATATAAAAAATAATAATATTAA
TAACAATAATAATAATGATAATGGGAGAAAGAAATCCCTAAAAAA
AAATTGAAAATGGGAGAAAGAAAACCAAGAAGGGTTTGTTTCATC
TCCTTTCTTCCCATAAGCCTTTTTCTTGTATTGGTCCCTTCTCTT
CTCT

SEQ ID NO:378 25062        9120_300296_1
TATGTGAGAGATATAGTAACTACAACTGAATGAAAAATCCATGAG
ACAAAAAGTTCGCAATAGAAGAATATTGATTCGGTAACAAAGCA
CAGCTTATAAGTTTTCTTGTGTTAAAGATGAACCAATTTGAAGCA
TTAGAGGATAAACTGGACTAAACTCTTTGTCCCCTCTCGATCTGA
TCTTCACTGCATAATCATCCAAAGTTGCTTTTATCCCTTTCCAGA
TCTGATCCTCTCTTTGGTTATCAAGCCACAGTGAGTACTGTTTAG
GACTTAGTCTGTTCTTCTGCATCGGTGACTCTAACTCGTCTGGGC
CTCTTGTGTAGAGATGATGTAGGACGATGCTCGGTGGTAGATCAT
TGATGAGAGGAGATGATCCCATTTGAGATGTTTCCAGGAAAACCA
AAGGCCTAAACGCTCTAAGAGCTCTGTACGGTGCTCCGAGTTGTT
CCACGGGAAATAGATTCTGTCCCACTGCTAGTTCCAGCTCGGCCA
TGTCTTTGGCCATTCTGAGTTTTCCCCATTCTGAAAGTGGTCGCA
CAAGGGATGCATGTCTGATGTAGAAGATCAAAACCCTTGACGCCA
TTTGTCTTGTGAGTCTTGTGCAGATCGATTCTGTTcctgc SEQ ID NO:379 25080        18745_300241_1
GGGGGTTCAAGCTGTTGTTAAAAAATATGATATCTTGATCATTGC
TGATGAGGTGATATGTGCATTTGGAAGGCTCGGGACAATGTTTGG
CTGTGACGAATACAACATTAAGCCAGATCTTGTGACCTTAGCTAA
GGCACTGTCTTCAGCATATATGCCGATTGGAGCCATTCTTATGAG
CCAAGAAGTGGCAGATGTCATAAATTCTCATAGCAGCAAGCTAGG
CGTTTTCTCCCATGGATTTACTTATTCTGGGCATACAGTTTCGTG
TGCTGTAGCAATTGAAGCGTTAAAGATATACAAGGAGAGGAACAT
ACCAGAGTATGTCGCCAAAGTTGCCCCAAGGTTTCAAGATGGAGT
TAAAGCGTTTGCCTCTGGTAGTCCTATTATTGGAGAGACAAGAGG
AACAGGTTTGATTCTTG SEQ ID NO:380 25080        187837_300681_1
CAAGAAGAAATTTATTGCACGATCAAAATCATACCATGGATCAAC
ACTAATATCAGCTAGTCTATCCGGTCTTCCTGCACTGCATCAGAA
GTTTGATCTGCCTGCACCTTTTGTTCTGCACACGGACTGCCCTCA
CTACTGGCGCTTCCATCTTCCTGGTGAAACATAAGAAGAATTTGC
AACTAGACTTGCCAATAATTTAGAGGAACTTATCCTCAAAGAAGG
ACCAGAAACAATTGCTGCATTCATTGCAGAGCCTGTGATGGGTGC
TGGTGGTGTCATACCTCCTCCAAAGACCTATTTTGAAAAGGTCCA
AGCGATCGTTAAGAAGTATGACATCCTTTTCATAGCAGATGAGGT
CATTACTGCATTTGGAAGGTTGGGAACCATGTTTGGAAGTGATAT
GTATAACATCAAGCCAGATCTAGTCTCCATGGCCAAGGCGCTTTC
ATCTGCCTATGTGCCCATTGGAGCAATTATGGTTAGCCCAGAAAT
ATCAGATGTTATTCATTCTCAGAGCAATAAGCTCGGTTCATTTGC
TCATGGATTTACATACTCTGGCCATCCAGTTGCATGTGCTGTCGC
CATAGAAGCCCTGAAAATTTATC FIGURE 9m

SEQ ID NO:381  25080       9055_300296_1
GGGGGGCCCCATTATGGGTTATTCCTCATTAAAAGGGCCTTATTT
AAAGACTTGTGGGGGGTTAAAAAAAAAAACAAGGGATCCAACCTT
TGAGAATTTAAAAAACTTTTTTCATAAACATCATTTGGACTCTGT
TTTTCACTTTTTGGGCGGACCCTTGAGTTTTTTTACCTTTTTTTC
CGTGGCCTTAAAGGCTTTCCCATAA

SEQ ID NO:382  25080       284401_200098_1
AAAATCTGGAAGATCTTATCCTCAAAGAGGGGCCTGAAACAATAG
CTgCTTTCATTGCTGAACCAGTTATGGGGGCAGGTGGTGTCATAC
CTCCTCCAGCAACTTATTTTGACAAGATCCAAGCTGTGGTGAAGA
AATATGACATTCTTTTCATAGCGGATGAGGTCATCTGTGCCTTTG
GGAGACTTGGAACAATGTTTGGCTGTGACAAGTATAACATCAAGC
CCGATCTTGTCTCCCTAGCCAAGGCTCTTTCTTCTGCATATATGC
CAATTGGAGCTGTCCTTGTAAGCCCTGAAGTTTCTGATGTAATAT
ATTCTCAAAGCAATAAACTTGGTTCCTTTTCTCATGGATCCACTT
ATTCTGGGCATCCTGTGTCATGCGCGGTGGCATTGGAAGCTCTTA
AGATCTACAAGGAACGAAATATGGTTGAGAAAGTAAATAGAATAT
CCCCAAAGTTCCAAgaaggtCTGAAGGCGTTTTCTGACAGTCCCA
TagttggagagattagggGAaCtggTttga

SEQ ID NO:383  25080       248137_301580_1
TTTGAGGGCTTACGGAAGAATGGGTGAAGACGCTCTAAAGGATGA
GGCACTGCGGCACAACATGTTGTCGCCGTTCACGGCTGGAAGCCA
AATGATCAAAGGGGATCCATTGATCATCGAAAAATCAGAGGGAAT
TTATGTGTATGATACGCATGGGAATAAGTACCTGGATGCCCTTGC
TGGCCTCTGGAACATTGCGCTCGGA*GGAAGCGAGCCTCGTCTTG
TGGAGGCCGCAAAGAAGCAGCTCGATGTTCTTCC*GTACTATCAC
TCTTTCTGGAATCGCACCACTCCAGTCACACTGGAGCTCGCGAAA
GAGCTTGTGGAGG*TTTTCACA*GCGGTT*AAGATGAGCCGGG*T
TTTC*TTCACGAACAGTGGCTCGGAATCTAATGACTCTCAAGTGA
GGCTGGTTTGGTATTA*TTAC*AA*TGCGATTGGGAAGCCACAGA
AGAA*GAAGTTTATAGCACGGGAGAAAGCATATCATGGATCAAC*
GTACGCATCAGCCAGTCTCTCGGGTTTATCGAATCTCCACATAGG
CTTTGACGCGCCGGCGTCTTTCG*TTGTTCATACTGATTGCCCGC
ATTATT*GGCGATATCACTTGCCTGATGAAAGCGAGGAGGAATTT
GCTACGAGATTGGCCGAGAATCTAGAAAAGCTAATTTTGAAGGAA
GGACCTGAAACAATTGCTGCCTTCATTGGCGAGCCTCTCATGGCT
GCTGGCGGTGTCATGCCACCTCCAGCTACATACTGGGATAAGATT
CAACCGATTCTCAAAAAATACGACATACTTCTCATTGCCGACGAG
GTCGTCTGTGCGTTTGGAAGACTTGGAACTATGTTTGGCTGCGAC
TACTACAATATAAAACCCGATCTTGTCAGCTTAGCAAAGGCTTTG
TCTTCCGCCTATTTGCCTATCGGAGCTGTTCTCGTGAGCGAAAAA
ATTTCGGACGCTATTGTGAAATTCAGTGACAAGAATGGTGCTCTC
GGCCATGGATTTACGTATTCTGGACATCCCGTTCCTGTGCTGTT
GCTCTGGAAGCATTGCGCATATACAAGGAGAGAGACATTCCCGGA
CACGTCAGGAAAGTTTCTCCCCACTTCCAGAAAGGTTTGAAGAAA
CTCATCTCCAGTCCAGTTGTGGGAGAGATTCGAGGAACCGGCTTG
ATCATTGGGTTTGAGTTCAAAGACGGGAAGCGTCCAGAGAACACA
TTTCCAGCAGACTGGGGAGTATCGACATATTTCGCCCAGAAGTGC
AAAGAGGAAGGGATGCTTGTACGATTGTCTGGAGATGCAATCTTC
ATGTCTCCACCGCTGATAATCACAGTTGAGGAAATCGACGAGCTT

FIGURE 9n

ATCGGGATGTTTGAGAAAGCTCTCAAGGCCACCGAGAAGTATGTT
GAATCCAAGAAACACAGTGGATGATAGCGACGAGCAAAACGATGG
TAAAATACTTCTTTCCATACTTGTTTTAGTGCAAAAACGATCAAC
TTTCTAATGAGTTTAAGTCAAAC

SEQ ID NO:384 25080    1988_300335_1
GAAGGCGTTTTCTGACAGTCCCATATATGGAGAGATTAGGGGAAC
TGGTTTGATCCTCGCAACGGAGTTTGCAGATAACAAATCTTCCAA
TGATCCTTTCCCTCCTGAATGGGGTATTGGTGCATATTTTGGAGC
ACAGTGTGAGAAGAATGGTATGTTGGTA

SEQ ID NO:385 25118    1170750_302038_1
GCTCTATGTTGGGCGAGGGACAATTGTCACAACCTTTATCGTCTG
CTATGCACTCACTTCGTTCATCGCAGGCTATGTGAGTGGAGGCTT
GTACTCGAGGAATGATGGTAAACATTGGATCAAGTCAATGTTTTT
GACATCTTCCCTCTTTCCATGCCTGTGTTGCGGCATAGGCTTTGC
ACTCAACACGATTGCAATTTTCTACCACTCGCTTGCCGCCATTCC
ATTTGGTACCATGGTGGTGGTGGTTGTTCTATGGCTTTCATTTC
GCTACCCGCTAGCTCTGTTGGGTACTGTGTTTGGGAGGAATTGGG
CTGGTGTTCCGGACAATCCTTGCCGAGTCAAAACCATTCCTCGAC
CCATCCCAGAAAAGAAGTGGTACTTGAAGCCATTAATCGTGTCTC
TTATGGGGGGCTGCTTCCTTTCGGAAGCATTTTTATTGAGATGT
ACTTCGTCTTCACATCCTTTTGGAACTACAAGGTATACTACGTAT
ACGGCTTCATGTTGCTGGTGTTTATCATCCTTATGATTGTGACCA
TATGTGTGACGATAGTGGGA

SEQ ID NO:386 25118    129267_300404_1
CCCCCCCCTCAAATCGGGGAGGATTGATGACCGCGATGCTTCTTG
TCTGGGTCTTGATGGGGTTGCTTGCTGGTTATGCTTCTTCACGCC
TCTACAAGATGTTCAAGGGTTCAGAGTGGAAGAGAATAACTATGC
GCACAGCCTTCTTATTTCCAGGGATTGCTTTTGTTATCTTCTTCA
TATTGAATGCTCTTATTTGGGGGGAGAAGTCATCTGGTGCCGTCC
CTTTCACCACTATGTTCGCCTTGGTCCTCCTTTGGTTTGGTATCT
CAGTGCCTCTTGTGTTCGTTGGGAGCTATCTTGGATTCAAAAAAC
CTGCCCTGGAACCTCCAGTTTAAAACCAACAAGATTCCAAGGCAG
ATCCCCGAGCAAGCTTGGTACATGAATCCAATCTTCACTATTCTA
ATTGGTGGCATTCTACCATTTGGTGCTGTTTTCATTGAGCTATTC
TTCATCCTCACCTCAATCGGCTTCACCAATTCTACTATATCTTT
GGCTTCCTCTTCCTCGTCTTTGTTATCCTCATCATCACCTGTGCC
GAGATTACGGTCGTGCTCTGCTATTTCCAACTGTGCAGTGAGGAC
TACATGGTGGTGGAGATCTTACCTCACTTCGGGATCCTCAGCA
CTTTATCTCTTCTTATATGCTGCTTTCTACTTCTTCACGAAGCTG
CAGATTACTAAGCTGGTGTCTGGCATCTTGTAC

SEQ ID NO:387 25118    145896_301062_1
GGCAAATACCAGAGCAAGCATGGTACATGAGACCAGCTTTTTCTA
TACTTATTGGGGGTATTCTCCCATTTGGAGCTGTTTTCATTGAGC
TGTTCTTCATCTTGACCTCCATATGGCTGAACCAGTACTACTACA
TCTTTGGTTTCCTTTTCATCGTTTTCCTGATCTTGATCATTACAT
GTGCGGAGATAGCCGTCGTGCTTTGTTACTTCCAGTTGTGCGGTG
AAGACTATCATTGGTGGTGGAGAGCTTATCTGACTGCTGGATCCT
CTGCTTTATACCTGTTCCTATACTCCATCTTCTATTTCTTCACCA
AGTTGGAAATCACAAAGTTTGTTTCAACAATCTTGTATTTTGGCT
ATATTTTGATTGGATTATATTCCTTCTTTGGGTTAACAGGAACAA
TTGGATTCTATGCTTGCTTCTGGTTT

FIGURE 9o

SEQ ID NO:388 25118      153195_200159_1
GTCGATGATCCTTACAGCGTCACTTTTCCCCTTTATGTGCTTTGG
CATTGGGTTCATTCTAAACACGATTGCTATATTTTATGGATCGTT
AGCTGCTATTCCCTTTGGAACAATGGTGGTGGTTTTTGTTATTTG
GGCTTTTATTTCATTCCCTCTGGCGCTTCTGGGTACTGTTGTAGG
AAGAAACTGGAGTGGTACGCCAAACAATCCGTGCCGTGTTAAGAC
CATACCCCGTCCTATCCCTGAGAAGAAATGGTACCTCACACCATC
TGTAATTTCTCTGATGGGAGGTCTTCTTCCCTTTGGGAGCATTTT
CATTGAGATGTATTTTGTCTTCACTTCCTTCTGGAACTACAAGGT
CTACTATGTATATGGTTTTATGCTTCTTGTATTTATTATCCTGAT
CATTGTCACTGTTTGTGTGACAATTGTGGGCACATATTTCTTGCT
GAATGCGGAGAACTACCATTGGCAATGGACTTCGTTCTTCTCTGC
TGCCTCAACAGCTCTCTATGTGTATTTATATGCGATATATTACTA
TCATGTAAAGACCAAGATGTCCGGTTTCTTCCAGACCAGCCTTTA
CTTTGGCTACACTATGATGTTCTGCCTTGGCCTCGGTATTCTTTG
TGGTGCTGTAGGATATCTCGGCTCTAATTTGTTCGTTAGGAGGAT
TTACAGGAATATCAAGTGTGATTAAGCGCCTAAATGAAGCAATAT
TGAAATGCTGC

SEQ ID NO:389 25118      172086_300539_1
gtccattggttctctatcggaaactcttgtgttacagtcctcctt
ttgactggattcttggcgaccatcctcatgcgagtACTGAAGAAC
GATTTTGTCAAGTATGCCCATGATGAGGAAGCAGCTGATGACCAA
GAAGAGTCTGGATGGAAGTATATCCATGGGGATGTCTTCCGGTTC
CCCAAGAACAAGTCCTTTTTTTCGGCTGCTCTCGGCACCGGAACT
CAACTGTTTGCCCTCACAACCTTTATATTCCTTCTTGCACTTGTT
GGAGTATTCTACCCGTACAATCGTGGTGCTCTTTTTACTGCATTG
GTTGTCATCTATGCTCTCACTTCAGGAATTGCTGGGTATATTGCA
ACCTCTTTCTACTGTCAGCTAGAGGGAACAAACTGGGTGAGGAAC
TTGCTGTTGACAGGATGCCTGTTCTGTGGACCCCTTTTCCTGACT
TTCTGCTTCCTAAACACTGTTGCTATTGCTTATAGTGCAACAGCA
GCTTTGCCCTTCGGCACTATCTGTGTCATTGTGCTCATCTGGACC
TTGGTTACATTTCCCCTTCTAGTTTTGGGAGGCATTGCTGGTAAA
AACAGCAAGACTGAATTCCAAGCTCCCTGCCGTACCACCAAATAT
CCTATGGAGATTCCTCCACTTCCGTGGTACCGGCAAACAATCCCG
CAGaTGGCTATGGCTGGGTTTTTACCTTTCAGTGCCATCTATATT
GAGCTCTACTACATCTTTGCTAgtGTTTGGGGCCACAGGATTTAC
ACAATTTACAGCATTCTCTTCATAGTCTTCATCATCCTCCTTATt
gTTACTGCCTTCATTACTGTTGCACTGACGTACTTTCAGCTTGCT
GCTGAAGACCATGAATGGTGGTGGAGGTCATTCCTATGTGGAGGA
TCAACTGGATTTTTGGTCTATGGGTATtgtCTGTACTACTATTAT
GCACGATCAGATATGTCTGGATTTATGCCGACATCATTCTTCTTC
GGCTACATGGCTTGCATCTGCTATGCTTTCTTCCTGATGCTGGGC
ATGATCGGTTTCcggtgccGCAttgTTCTTt

SEQ ID NO:390 25118      146126_200014_1
cccCCTCGGATTCTTATCCCCTTCAAATCGCGGAGGATTGATGAC
AGCAATGTTGCTTCTCTGGGCATTCATGGGTGTGTTTGCTGGGTA
TGCTTCAGCCCGCCTTTACAAGATGTACAAAGGAACTGAGTGGAA
GAAAATTACTCTTAAGACAGCACTCATGTTCCCGGGCATTGTTTT
TGTTCTTTTCTTTGTGTTGAATGCTCTAATTTGGGGAGAGAAGTC
ATCTGGGGCAGTGCCATTTGGAACCATGTTTGCACTAGTATTCTT
GTGGTTTGGCATCGCAGTGCCACTCGTTTTTGTTGGTAGTTATGT
AGGTTTTAAGAAGCCAGCCATTGAGGATCCTGTGAAGACAAATAA
GATCCCTCGACAGATACCAGAGCAAGCCTGGTACATGAATCCAGT FIGURE 9p

```
TTTCTCTATCCTTATTGGTGGCATACTTCCATTTGGAGCTGTATT
CATCGAGCTATTCTTCATCCTCACGTCAATCTGGTTGCAGCAGTT
CTATTACATATTTGGTTTCCTCTTCATTGTGCTCGTCATCCTTAT
CATCACCTGTGCCGAGATCACCATTGTGCTATGCTATTTCCAGCT
ATGCAGCGAGGACTACCTTTGGTGGTGGAGATCATACCTCACTTC
AGGGTCATCTGCTCTCTACCTATTCCTGTATGCAGCATTCTATTT
CTTCACAAAGCTTGAAATCACAAAGCCCGTATCTGGTATGCTGTA
CTTCGGCTACATGTTGATCGCATCATATGCTTTCTTTGTCTTGAC
TGGCACAATTGGTTCTACGCGTGCTTCTGGTTCACGAGGCTCAT
CTACTCATCAGTGAAGATTGACtagaAGTGTCGTATTGCAGTTCC
TTGGGAGAGCATATATTACACTGCGGACCAAatTGTTTGTTGCTt
ccaggTTTTGATAGTataaag
```

SEQ ID NO:391 25118     253838_301630_1
```
AATCGCAGGTGAGGAACTTGCTTCTAACAAGCTGCCTATTCTGTG
GGCCATTATTCCTGACCTTCTGCTTCTTAAACACCGTTGCAATCG
CATACACATCAACTGCTGCACTTCCTTTTGGTACAATCATGGTCA
TTCTCCTCATCTGGTGCTTGGTAACATCTCCTCTTTTGGTCCTTG
GGGGTATCGCTGGCAAGAACAGCAAAGCTGAATTCCAAGCTTCAT
GCCGGACGACGAAGTATCCCCGAGAGATTCCTGTTCTTCCTTGGT
ATCGAAGCGCCATTCCGCAAATGGCGATGGCAGGATTCTTGCCTT
TCAGTGCCATCTACATTGAGCTTTACTACATTTTGCGAGCGTCT
GGGGCCACAAGGTGTATACAATCTATAGCATCCTCTTTGTTGTGT
TCATCATCCTGATCATTGTCACGGCTTTCATAACAATCGCTCTCA
CGTATTTTCAACTTGCAGCAGAGGATCATGAATGGTGGTGGAGAT
CTGTTCTATGTGGGGGGTCAACGGGCGTGTTTGTATACAGTTACT
GCTTCTACTACTATTTTGCTCGCTCCGACATGAGCGGCTTCATGC
AGACATCCTTCTACTNTGGATACATGGCTTGCATTTGCTATGGAT
TCTTCCTCATGCTTGGGATGGTCGGCTTCCGGGCCTCTCTCTTCT
TCGTT
```

SEQ ID NO:392 25118     231609_301207_1
```
CGCGTCGCAGGAACGCTCTGTGTCTTCGTGGGACCGGGAGTGCTG
TGCCTTGGCATGACGGTCGTGACAATGATCTTCGCACTCTTGGGA
TTCTCTCGCCTTCGAACCGGGGTGGACTCATGACCGCCATGGTGC
TGCTGTGGGTGTTTATGGGACTAGTAGCGGGCTACACCTCGGCAC
GCCTCTACAAGTCTTTCAAGGGCACTAACTTGTTTTAAGATTACC
ATGAAGACGGCGCTCATCTTCCCGGGGGTCATATTCACCATCTTC
TTCGTGCTGAACGCCATCATCTGGGGAGAGAAGTCGTCGGGAGCA
GTGCCTTTCGGAACAATGTTCGCGCTGGTCTGTCTCTGGTTCGGC
ATCTCGGTCCCGCTGGTCTTCGTGGGCAGCTACTTGGGATTCAAG
AAGCCGGCAATCGAGCCTCCTGTTCGGACCAACAAGATCCCGCGA
CAGGTTCCGGAGCAGGCATGGTACATGAAGCCCGTCTTCTCGGTC
CTCATCGGCGGCATCCTTCCATTCGG
```

SEQ ID NO:393 25133     201013_300712_1
```
TTCTCATCTCACCTGCTCGCAATGGCGATCAAGAAGAGCTCGACG
CAGGCGTTTCCCATGGGCGGCGGCGGCGCCAGCCTTCTCCTCGGT
CTCCTCCTCGTCCTCCCCGTGCCAGCCGTCTCGTCGTCGGACGCG
GAGGAGGCGGTGGTCTCCCGGTTCCGGGAGTACCTCCGCATCGAC
ACGGCGCAGCCGGCGCCGGACTACGCCGCGGCGGTGGCGTTCCTC
CGGGGGCAGGCCGGCGCCGCGGGGCTCGAGGCGCGCACGCTCGAG
CTCGTCGCCGGCAAGCCCCTGCTGCTGCTCCGGTGGCCCGGCGG
CGCCCGTCGCTCCCTTCGCTGCTCCTCAACTCCCACACCGACGTC
GTGCCGTCGGAGCCGGACAAGTGGGACCACCCGTCCTTCTCCGCC
```

FIGURE 9q

GCCCTCGACGAGGCATCCGGCCGCATCTACGCGCGTGGCTCCCAG
GACATGAAGTGCGTGGGGATGCAGTACCTTGAAGCCATCCGCCGT
CTTCGTAGTGCAGGCTTTATCCCAGATCGGAATATCTATCTTACA

SEQ ID NO:394 25133      24013_300072_1
TGAAAAAGCAGGAATGAATAATACAATTTGCCAATGCCAACTGGG
GGACAACAAGAACAAGATGTCTCTGATTTACCACAACAAACACAG
GATGGATTCAGATCTTATTGATTGTACAAATTTGCGAAAGGAAGA
CTTGAATGGGCTGTGTTGAGACCCTCATAACTCATCTCGTGAACC
ACTTTTGCTTTCATATGATGCATAAGCTTTGATGATTGAAACATA
CACCTCAATGCCTTTCAAGTACTCAGCTTTACCCAAATACTCATT
GTGGTCATGAAGCAGACTCGGGGTGTTTGATATGGGAGAGAACCC
AAAGGCAGGCACGCCAGCCTTGCGAAAGTAGCGAGCATCCGTTGA
TGCAGGGAAAATCTCAGGCTTACTGGTCCTACCTCCGGCTTCCTT
AACAGCATTTTCCAAGAGCCCCCACCAAGGATTTGAATCATCTGC
TGCTGTAAGGAATTGCTTCCCCGTAAGCTTCTGCTTGAACTCAAA
GGACATGTTTCGTGCTGCTGGAGCCCATTCCTCCACTAAACGTCT
TTCGAGTGCTTCAGCATCAACGCTGGGTGGAACACGAATGTCGAA
ACCAGCTTCTGCCTCAGATGGTTGCAGATTCATTACGAAACC

SEQ ID NO:395 25133      243257_301337_2
TTTTTTTTTTTCTTGCTCGTCTTTTTTCAATTTTTCTATAATAAT
GACGAGTATCAATAAGAACAAAAATATACACTAAACTTTGAGTTT
TCCAAAGATTTGACGGGTACATCCTCTTATTTTTTTCTGAGCTAA
AGTTCAGAGTGCGTCAAGGATTCGTCGTTCGATTCGTCGTTCGAT
TCGTCCTTTATTCCAACAAAGCTCGCGAGAGAATTCAAGAGAATT
TGGTATACTTCGATGCCTTTGAAGTATTCTCGAGAATTTAGAAAC
TCATGGTGATCGTGGAGAAGAACGGGAGTGTTAGCCATCGGCGAG
AATCCAAATGCTGGAATTCCAAGTCGCGGAAGTAGCGAGCATCA
GTCGAGGCCGGGAAGATCTCCGGTGTGGCAAGCTTCTGGTTCGAC
TTTGATATCGCTTCCCGGAACACTGACCACCAGGGATTGGAGTCG
TCCACTGGAGTATAACTTAAAGCGCCATCCTTTCTCCTGATCGGT
GTCTTCTGCTTAAACTCGTAAGTCATATTTCGCGATGCGGGAGCC
CATTCTTCCGCGATTCTCTTCTCCATGGCTGCGGGATCAGCAAAA
GGCGGCATTCTTATGTCGAAACCGGCCTCAGCCTCGGATGGCTGT
AGATTCATCACAAATCCAGTTGGGGT

SEQ ID NO:396 25133      23961_300219_1
CCCACGCGTCCGGAAGAATCCGAATCCAATTCAATGAGTCTTCTT
CGTCTTCTCCTCGTTGTTGTTGTTCTTCATCTTTCTGCGGTGGCC
GGCGACGACGCCATCGTCTCCAGATTCCAGGAGTACCTCCGAATC
AACACGGTTCAGCCCAACCCGGAATACTACAAAGCCGTTGACTTT
ATAATATCTCAGGCGAAACCACTGTCCCTCGAATCTCAGACGATC
GAATTTGTAAAGGAAAGCCGCTTCCTCCTCAAATGGGTTGGC
TCCGACCCAACCCTACCTGCCTTTCTCCTCAACTCCACACCGAT
GTCGTTCCCTTCGAGGACTCCAAGTGGACTCACCATCCGCTCCAA
GCTCACATGGACCACCATGGCGACATCTATGCCAGGGGTTCCCAG
GACATGAAGTGCGTCGGGATGCAGTACCTCGAGGCCATACGCAAG
CTCCAGGCTTCTGGCTTCAAGCCACTCCGATCCGTCTATCTCTCC
TTCGTCCCCGATGAAGagaTTggCGGCcAcGATGGCGCagagaAG
TtgCTGAATCcCAATTATtCAAGAGCTTGAACATCGCAATCGTG
CTCGACgaaggccTgCCATCGCcTACTGagagttACAGAGTATTC
TATGgagagaGGagTccCTggtggctggTgATt FIGURE 9r

SEQ ID NO:397  25144      8599_300308_1
AAAAGGTTCAAAATCATAACCCAAAACAAAAGAAATAAAcaGGAA
GCTCGAGTGCCAAGTACCTCCGCCACCTCCGATCAAAAACCCAAT
TCCGAGAATTGAGCTCCGACGGAAAATAAACGAAGCGGTAACACA
AACAACCAACCAAATACCAAACTACTAAAGTAAAGAAACTAAAAT
AGTCCTTCATTTCATCAGCGGAAGAGTTTTGATGTTCAAgttaa
CTTGGCACCCTTTTTGACTGcaaccttggtaACCttggctccaat
tgggtCCTtCTTgtCAacactcttGATAACACCGACtgcaACAg

SEQ ID NO:398  25164      25111_300074_1
CCCACGCGTCCGTGTAACCATGCCTTCTCTCTACGAAAAATCGGA
ACTTTTCTCTGTCACAGAGAATTTTCTAAATCCGAGATTCACCTG
GACCATTCGGGGATTCTCTACGCTGCTAAAAAACAGTTACCTATC
AGAAGTGTTCTCCATCGGAGGAAGAAGTTGGAATATACAAATCAA
TCCAAGTGGTCTTGGTACGGGAGAGGGAAAAGCTTTGTCGATGTA
TCTTGGCCTTAATGTGAATGAGATATTCAGACCATATGAAGAT
TTATGTTCGAGCCAAGCTTCGAGCTCTTAACCAACTCAATCTCAG
TAACATCGAAAGGGAACTCGATATTTGGTACAATGGTCCGGGATA
TGGAGAATATAGCTGGGGTTTCCCTGAGTTTATCTATTTCCCTTA
TCTCACAGATTCATCAAAGGGTTTCGTTAAGAACGATGTGTTGAT
GGTTCAAGTTGAAATGGAGGCCATTTCTTCAACCAAGTACTTCCC
GAGTTAGATTTTCTCTAAGCAAAGAACTTGTACCTACCTCCATGT
GTTTGATTTGTTATCAAATACTAATAAGAATTTGATTATGCATTT
CAAATACAATTGTTTCTTTTTCTTAAAAAAA

SEQ ID NO:399  25170      15505_300353_1
aaTGAgttcAAATCTAGCGACTTTCGTCGTATGAAGAAACAAGTTG
CTCGGATGTTGACGGTTAAAAGAGAGAGGGAGATCAAAGAAGGGAT
AAAGAAAAGGTTGTCGAGGAAACTTGACAGACAATGGAAGAAAAGC
ATAGTACCAAGACCACCTCCGTCTCTGAAGAAACTTCAAGAAGAAG
AAGCTGCAGAAGAAGCAGCTGAAGCTGCTAAATCTGCTTGAAAAAA
CCCGCTATTGATTTATGGTCTCTTCCTTGTTGTTTCCTCGAGATGT
TGTTAATCTCTGTTATTTGTTGCTGAACCATCTTGTATTTGTTTTT
CTTTTGGTGTAAACACTTTCCTTATCAAGTAGTTTACATGaatccc
ttaaagcggccgcaagctcgag

SEQ ID NO:400  25176      25119_300073_1
TTTTTTAAAATTTAAAAACATATTTTCAAATCAATGTAAAATAGAA
ACGTTGAAGAGAGAAACAACTGAAGAATGGGGGCAAAGCGCCAGAA
ACTTGTAAAAACAAGTAAAAGGATTGGCAAAAGTAAGAAAGCACAC
CACTTTAAAACTAACATTAAGCTTTGGATGATGATGATTCTTCTTC
GTCATCTTCATCAATGTCCCAACTTAAATCTTCATCTTCCTctgca
GCACTCAGACGTTTACGAGCTCagctctgtTTGGACTACCACCaga
CCGACtCgTTTccTTACCATCTATGCTACTCATATCCTCGATCTCG
TCCCAtccCAAATcc

SEQ ID NO:401  25196      1113947_301907_1
ATGCACCTCCTCTCTGCGCATGCATTTCTCTGATCCCAACCCTGGT
TCGAACCCTAACCCTAACTCTAACCCTAACCTTAGGGGGGGTTGGG
TTGGAGTATCCCCGGGCCTGCCCCCGCTAAAGAATCCCTGCTGCTG
CCGGCGGGGGCCGGCCCAGCTACGCCGGGTTGCTTGCGAGGTTGCT
GTCGAGGTCGGGGGCCAGAAGGTCGATGGCGATGACAATGGAGCGG
GGAAAGCGGCTGCGGGCTCGCGCGTGCGCGTCTCGGTGCCCCTTAC
TGTCTACCATGTCGCCAAGGCCCCGGAATTGGACCTGGAGGGCCTT
GAAGGCGAGGTCAAAGATATTCTCCACAGCTTCAAAGGCAAGCCCA

FIGURE 9s

TCTCCGCCAATCTGCCCTACAAGGTGCAGTTCTTTCTCGACGTCGA
CGGCAAGCAGGTCAAATTCTTCGCCCACTTGAAGGAAGGGGAATTC
GAGGTTATTGCTTGATATCCAATCTCCCCC

SEQ ID NO:402 25196     16555_300240_1
CCCACGCGTCCGGATATGAGTAGCCAAATCGCTTTGTCACCGGCCA
TCGCCGCCGCCATTCGCCGTCCGTCCTCTCACGACTGTCTATCCGC
TTCCGCCACTACTGCTACCGCCACCCCATGGCTCTCAAATCTTGC
ATCGTCGCACCTCTCTCGCTATTCACCTCTCAATCTCAAATCAAAC
ACTCAAGCTCAAGAAAAACTTCTCGAACCACGATTCGATGCGATGT
AGCGATAAAATCCGCAGATTCGATAAACGCAGACGCCAATCCTTCG
TCCTCACCGTCATCAGAGGAAGAAATCGAAGCGGAAGCGAAGGCGA
AGATAGGATCTAGGGTTAGAGTAACTGCACCGTTGAAGGTTTATCA
TGTAAATCGAGTTCCAGAGGTTGATTTAGAAGGTATGGAAGGTAAA
CTCAAAGATTACGTTGCTGTTTGGAAAGGGAAACGAATCTCAGCTA
ATCTTCCTTATAAGATTGAGTTCTTCAAAGAAATTGAAGGTCGTGG
TCTTGTTAAATTTGTTTCACATCTTAAGGAAGATGAGTTCGAGTTC
ATTGATCAGTGATGAAACAAGAAAGACAATTTTTGTTTTCCTTTCT
CAGTGTTTGTTTTTGTTTGTTGTGTTTACTGGAACCTGGGAATGGA
GAATGATTTGTATGTAGTGTGATGTGTATTCAACCTTTAGCAATCA
TATACATAAGGGTTTCTTCAAaa

SEQ ID NO:403 25196     267852_200119_1
ATGACTGCTTCAAGTTCAGCTTCCTTTACATCATCAATTCTCAACA
TTCCCAATTCTAAAACCTCATCTTTCATTTTAAATCCTAACCCTTT
TCCCCAAATCAAAGTTAACAAATCAAGAAACCCTAAAAAAACAAAT
GGGTATTTCATTTCTAGGTCTGTAACAGTCGATAACCCCACCACTG
TATCCTCTTCATCTGCATTGAACTTAGATGAGGGAATTGATGAAAA
AACTGCTGAAGCAATTGGGAAAGTTGGATCTAGGGTTAGGGTTACG
GTTCCGTTGAAAGTGTATCACGTGCCTAAGGTTCCTGAATTGGATT
TGGTAAATAGAATTGGAACTTTGAAACAATACGTGGGTTTTCACAA
AGGCAAACAAATATCAGCTAATTTGCCTTACAAAGTGGAGTTCGTG
GTGGATAATTTGGAAGGGCGAGATGGTCAGGTTAAGTTCTTGGCAC
ATCTTAAGGAAGATGAGTTTGAGTTTCTTGACTGATTTAATCTCTA
G*TTTTTGATTTGATAATTTTAGTGCTTTCTAAATGATTACTGTGT
TCCACCGAATATATGAGAATAATAATGTGTACAAGTATTATTTTCG
TGTATCATTTTGTACATCTAATTTTTTAAATAAAAAAGatggttaT
TTtggctc SEQ ID NO:404 25196     201347_300715_1
CCCACGCGTCCGCGGACGCGTGGGCGCCAACGGCGACGTCTCCTCG
CCGTCCTCGGACGTGGCCGCCGAGGAGTCCGCGGCGGCCCCCAAGA
TCGGCAAGCGCGTGCGCGTCACGGCGCCGGTACGCGTCCACCACGT
CTCCAAGGCGCCGGACCTGGACATCTGTGGCATGGAGGGTGTGGTC
AAGCAGTACGTCGGCATCTGGAAGGGCAAACGCATCACGGCCAATC
TCCCCTTCAAGGTGGAGTTCGAGCTCAGGGTGGATGGGCAGGACAA
ACCGGTCCGGTTCTTCGCCCACCTTCGAGAGGACGAATTCGAGCTC
GTCGAAGACGAATAGCTGAATAGGTCTCTTTTACAGAATAATGTGC
TCTCGTCGTCTGCAGTCTGCAGATGCAGTATCTGTATATTAGAAGA
GAAGATTGAAGAGGGTGCGAGGAGATCGCAAGTAAGTTGTTGTTTG
TTTACTTGTCGCGTGCTCTTCCTCACTCTTTTGTAGTTCTGTTAAA
CACCAACATTTTGAGATTTGAGAAACTGAGAACGGTTCGGATTATG
ACAATTATGAATGAAAGTGGTTATACTGATGGTTCTGTTGTTGGCT
GT FIGURE 9t SEQ ID NO:405 25196        25158_300098_-1
GGTTTTTGGAAAAAACCCTTATGTATATGATTGCTAAGGGTTGAAT
ACACATCACCCTACATACAAATCATTCTCCATTCCCGGGTTCCAGT
AAACCCAACAAACAAAAACAAACCCTGAAAAGGGAAACCAAAAATC
GCTTTTTTTGTTCAATGACTGAACAATGAACTCAAACTCATTTTCC
TTAAAATGGGAAACAAATTTAACAACACCACGACCTTAAATTTTTT
TGAAGAACTCATTTTTATAAGGAAAATTAACTGAAATTCATTTCCC
TTTCCAAACAGAAACGTATTTTTGGAGTTAACCTTCCATACCTTTT
AAATCAACCTTTGAACCTGGATTTACATGATAAACCTTCAGCGGCG
CTGTTACTTTAACCCTAGATCCTATCTGGACCTTGGGTTCCGTTTC
ATTTTTTTCC SEQ ID NO:406 25414        122230_300017_1
cccccggtgcacgtacgtgtagccgccgccgcagataGTACACCG
GCTATCTATCCATCTATCTACTCAGCTTTGCGTCCTCCCGCGAATT
CACCGCAGCAATGGCGTCCCTCGTCGCCGTCCAGCCGGTCGCCGTG
AAGGGCCTCGCCGGCAGCTCCATCTCCGGCAGGAAGCTCGCCGTCA
GGCCGTCGCCCCGGGCGCTCTGCCGCACCACCCGCAGGCCGCGCGC
CGCCGTGGTGGCCAAGTACGGCGAGAAGAGCGTCTACTTCGACCTC
GAGGACATCGGCAACACCACCGGGCAGTGGGACCTGTACGGCTCCG
ACGCGCCGTCGCCGTACAACCCTCTCCAGAGCAAGTTCTTCGAGAC
GTTCGCGGGGCCCTTCACCAAGAGGGGGCTCCTGCTCAAGTTCCTG
CTGCTCGGCGGCGGATCGCTGGTGGCCTACGTCAGCGCGTCGGCGT
CGCCGGACCTGCTTCCGATCAAGAAGGGCCCGCAGCTGCCGCCGAC
GCCCGGCCCACGCGGCAAGATCTGAATTAAATTCCTCGTCTCTGCC
TCACCTTCTTCTTGATCCGATCCATCCATGCAAATCCTCTGTACTG
TACTGCTAGTCCCCATGGCCGGATCGCCATGGATTAATTC SEQ ID NO:407 25414        8030_300286_1
AATTCGGCACCAGAAAATTCCCACTCACCACACACAACAAAAGAAT
AGTGATCGAAGCTCATGGCGTCTCTTGCAACCGTCGCCGCTGTGAA
ACCATCCGCCGCCATAAAAGGACTCGGCGGCAGCTCACTCGCCGGA
GCTAAGCTCTCCATCAAGCCTTCCCGCCTGAGCTTTAAACCCAAAT
CCATCCGGGCTAATGGTGTGGTGGCTAAGTATGGAGACAAAAGTGT
CTACTTTGACTTAAAAGATTTGGGTAACACAACAGGTCAATGGGAC
GTATACGGCTCTGATGCTCCTTCTCCTTACAATCCTCTTCAGAGCA
AGTTCTTTGAGACATTCGCTGCCCCATTCACAAAGAGAGGATTGCT
CCTCAAGTTCTTGATCCTTGGAGGAGGCTCTTTGCTTACTTATGTC
AGCGCTACCT SEQ ID NO:408 25414        29620_300154_1
ctgaattctgaaaatagttttgttagtttggagtgaaaagccatgg
catctTTGGCAACCTTTGCTGCAGTGCAGCCCACTACCAATGTCAA
GGGCCTAGCTGGAAGCTCCATTACTGGAACTAAGCTTCATCTCAAA
TCATCTCGCCTCAATTTGAAGACCACTAAATCCAGGGCCGGCCCTG
TGGTTGCCAAATATGGTGACAAGA*GTGTATACTTTGATTTGGAGG
ATTTGGGCAACACCACTGGCCAGTGGGACCTGTATGGATCAGATGC
ACCTTCACCATACAACTCTCTTCAGAGCAAGTTCTTTGAGACATTT
GCTGCTCCATTCACCAAGAGAGGTCTTTTggtCAAATTCTTGATAT
TGGGAGGTGGCTCCACCCTTGCTTACTTCAGTTCGACAGCATCAGG
GGATATCCTACCAATCAAGAAAGGTCCACAACTTCCACCCAAGCTC
GGCCCACGCGGCAAGATCTAATTGCTTTCGGTCCAAAATTCAACCT
TCAATTTGTAATTGATGTATGTttccccagtttgtgtaagtataat
tgaagactttccattataacaagttatatcttatggaaaatttgta
gcattgcttt FIGURE 9u

SEQ ID NO:409 25414      257226_301680_1
GAAGAACACTCTTGTAAGAGGCGATGGCCGCCGCAACAGCAGCAGC
ATTGGTACCGTCTGGACTTGCCAACAGCAGCTTGAATGGAACGAAG
CTGCGAATCAAGCCTGCAGGACAAGTCTCAATGAGAAGATCCACTG
CCAAGCTCGGTGTATCGGCAAAGTATGGAGAAAAGAGCATCTACTT
CGATCTTGGAGATATCAACAACACCACCGGAGCTTGGGACTTGTAT
GGATCTGATGCACCTTCTCCTTACAACGGACTCCAGAGCCGATTCT
TCCAAATCTTCGCTGGTGCTTTCACCAAAAGGGGCCTGTTGCTAAA
GTTTCTGCTGCTTGCCGGTACCGGTGCTGTCGCTTACGCTGGAGTT
AAGGCATCCCCGACTTACCTCCCTGTCAAGAAAGGAGCCGTCGGGC
CGCCAACGCCAGGTCCCAGAGGAAAGATCTAAACTCCATTCCAAAT
TACCGAGACCATCCCTGTTCTGTAAGTTCGCCACCAGGAATGTAAT
CTTCTTCCTTCTTGTGGAAaaaaAa

SEQ ID NO:410 25414      145296_301058_1
GTGAAGAGCATGGCATCTTGGGCAACTCTTGCTGCAGTACAGCCCA
CAACTGCCGTCAATGGGCTAGCTGGAAGCTCCATTATTGGAACTAA
GCTACATGTTAAATCATCTCGCCTTAATTTGAAGTCTACTAAATCC
AGGGCTGGTTCTGTGGTAGCAAAGTATGGTGACAAGAGTGTATACT
TTGATTTAGAGGACCTGGGAAACACCACTGGCCAATGGGACTTGTA
TGGTTCAGATGCACCTTCACCATACAACTCCCTTCAGAGCAAGTTT
TTCGAGACTTTTGCTGCTCCTTTCACTAAGAGAGGTCTGTTGCTCA
AATTCCTGATATTGGGAGGTGGCTCAACTCTTGCATACTTCAGTTC
AACTGCATCAGGGGATATACTACCAATCAAGAAAGGACCTCAACTT
CCACCCAAGCTTGGGCCACGCGGAAAGATCTAATTCCTTTTCAATC
CAACTTTCTCAACCTTCATTTTGTAATTGATGTATCTGTCCCCAGC
TTGTAAGTATTCTTGAAGCCTACCTGAGACCTTTGTTAC

SEQ ID NO:411 25414      168110_300553_1
gaattcatgaagaacaaatctcagtataaacgagaaaaatctacta
cgtagagccgttctaaagctcggttaagaatacaAATGGAAAATCA
AACCCTATGCTTAAAAATATTCTTCCTTTTGTTACATAAATTTTAG
GAAGAAAATGAAGAACAAGAGCCATACAAATTCTCATGTGTCCTCT
ATGAATGGCTTCTCTTGCAACCTTAGCTGTTGTACAACCTACCGTC
GTTAAAGGCCTCGGAGGAAGCTCCATCACCGGAACCAAGCTTTCGG
TTAAGACTACTGCTCGTCGTAGTCTGAGACAAACTAAAATCAGGAC
TGGTGCCGTGGTTGCCAAATACGGTGACAAAAGTGTGTACTTCGAC
TTGGAAGACATCGGTAACACTACCGGACAATGGGACTTGTACGGTT
CTGATGCACCATCTCCCTACAACTCTCTCCAGAGCAAATTCTTTGA
GACATTTGCAGCTCCATTCACCAAGAGAGGTTTGTTGCTCAAGTTC
TTGATAATTGGAGGAGGTTCAACACTTGCATACTTGAGTTCAACAG
TCTCAGGTGACATCTTACCAATCAAGAAGGGTCCTCAATTGCCTCC
TAAGATGGGTCCACGTGGAAAGATCTAAATGCTGAAAATGGAAACT
CGACATCCTTTGTggTTGAGttACAGTTTATCTTAATTTTCAGAAt
tTGTAACTATGACAttGGTTTATaACTAGTCTTGTttTCGTGTGTA
CATCATAAACGATTCGGTTCGaaggcaaTTtaagaTCATTTTATGA
TaaAAAaaaaAA

SEQ ID NO:412 25414      255053_301641_1
AAGGATAGCAGAGAGAGAGAGAGAGAGCCATGGCAGGATTAGCA
TCGACATCTTCCGCCGTAGCATGCGGTGTGACCTCGTCTTCTCTCT
CTGGCCAGAAGCTTGCTATTGCGCACTCCAACCTCTCTCTTCCCAG
GGCTAGCCCAAGAGCGGGAGTAGCTGTCGCTAAATATGGTGAGAAG
AGTATGTACTTTGACCTTGAAGATATCGGTAGCACTACCGGTTCTT
GGGACCTCTATGGAGCCGATGGACCTTCCCCCTATAATGGATTGCA

FIGURE 9v

GAGCAAGTTCTTTGAGACAACTGCAGGAGCATTTACCCGTCGAGGC
ATTCTTTTGAAGTTCTTGGTCTTGGGTGGAGGCGGCACTCTTG*CC
TACGTTAGCTCCACTGCAGGAAAAGTTGTCCTGCCCATCAACAAAG
GACCTCAGGAGCCCCCTAAGGTTGGACCCCGAGGCAAGATCTGAGT
ATTAACTCTATGTATCAAATCTATCTCTCATGTGGATTCCAAAAGA
ACTGATAAATCCAGATAAGTTGGCTTTTCTGTGTAATTAGTTTTTG
TTCCTGTTAGTTGTGAATGCAACAAATTCTATGAATTGGG

SEQ ID NO:413 25421      25414_301725_1
ATCTGAAGTCTGGCAAGTCATTTATCAAACTCGGCGGAGCCAAATG
ACAAAGTAGACCCGCACGGTCATTGAATAGTACGTGTACAACATAA
GCAGTGTTCAATACCAGTATTTGTCTCTCTTCGTTGAACAAACC
AAAGGATCTGCAAATCATCACTCTCTACTTCCGATCTCTCCGCTTC
CTTTCTGCTCTCCTCTTGTCGTCTTCCCATTCACGGTCATAGATTG
GGTCAGGATCACGACGAGCCATTTTGCTGGAAGCTTCTTTTCCAAG
AAGTCTGATGCTTGGCTCTTCAAGATAACCTCCGTGTTAATCATA
CTACTGCTCTTCCGCTCTCTGCCTTCGTACGATGATGGTCCCATAC
TGGTCGATAAAGACGAATGATGTGGCATAGGAGAGTATTCTCCTGG
CT

SEQ ID NO:414 25427      1100534_301461_1
ATCATCATCATCATCATCGAAGAAGCAGGAAGCTAAATGGGGAAGA
GTACATTCAAGCAAGAGCATGACTTAGATAAGAGAAAAGCAGAGGC
TGCAAGAATTCGAGAAAAATACCCTGATAGAATTCCGGTCATTGTG
GAGAAGGCTGAGAGAAGTGACATTCCAAATATTGATAAGAAGAAGT
ATCTTGTTCCGGCTGATTTGACAGTTGGCCAGTTTGTATACGTGAT
CCGAAAGCGAATCAAACTCAGTGCTGAAAAAGCCATCTTTATCTTT
GTTGATAATATTCTGCCAGCTACTGCTGCTATTATGTCGAAAATCT
ACGAGGAGCACAAGGATGAAGATGGGTTTTTGTATGTTACATACAG
TGGAGAGAACACATTTGGGGTTAGGTAACTTTCTTGCATACCTAAT
ACCTATGGGTTTATTTCTCATAGCTCAAAAATGATGACAATCGAAG
CATATCCCTGCTTAGAGCAAATAATTGAAACATAAATGGTGGCACT
CTTCTGTATATAGTGTGGAAATGGTTTGGTACATCTGAACCAAGAT
TGAAATTAATGGAACTAATTCTCACGAGTCTTA

SEQ ID NO:415 25427      25427_300073_1
TTTTTAGAGAGTCAAATTAGAATCTTGTTTCAAATACCATCTTCAAA
TGCAAGAGATAGTAAGAGAGCTCAAAAGGTTAAACCAAGAAAGTAAA
ATGACATTATTAAGGTCGACGAGAATGTACAATCATCAAGAGGATCA
GACGTAGAAGCTGAGGTAATTAGCAGTAGAAAGATCCACCAAATGTG
TTCTCTCCACTGTATGTCATGTAGAGAAACCCGTCTTCGTCTTTGTG
TTCTTCGTAGATTGCAGACATCAATGCCGCAGTTGGTGGTAATGTGT
TCTTGACAAAGACAAAGATGGCTTTTTCAGCTCCAAGCTTGATTCTT
TTCCTCACAACGTACACAAATTGGCCAATGGTTAGATCAGCTGGTAC
AAGATACTTCTTCTTGTCAATGTCAGGAACATCACTCTGTCCAGCTT
TTCCACAATCACGGGAACTCTTTCAGGcgGAcgcGTGGG

SEQ ID NO:416 25427      248754_301586_1
AAGCGACGACGCGATCAATCAAGCGCTTGTTTGGAACTTGGAGCCAA
CCGACCATGGCCGCCGGCAGCACCTTCAAGCAGGAACATCCACTCGA
GAAGAGGCAGAAGGAAGCGGCAAAGATCAAAGAGAAGTATCCCGACA
GAGTACCCGTTATTGTAGAGAAGGCGGCTAAGACCGACATGGCTGAC
ATCGACAAGAAGAAGTTCTTGGTTCCAGCCGACTTAACCGTTGGCCA
GTTCGTCTATGTGATCCGGAAGAGGATCAAGGTGGGCGCAGAGAAGG
CAATCTTTGTTTTCGTTAAGAACACGCTGCCACCCACGGCGTCTTTG

FIGURE 9w

ATTTCAACCATCTACGAGGAGCACAAAGACGAGGATGGATTCCTCTA
CTTCACGTACAGTGGGGAGAACACTTTCGGCCAAGACGTTCTCTAGA
CACTGACTTCACTTCTGTACAAAGCAATTTCTTTGTTGATACGTTTC
CTTTGTGGATTGTGTAACTTAAAACTTATCTAAATCTTAT

SEQ ID NO:417 25427 23445_300105_-1
CCCACGCGTCCGCCTAATTCTGTTTTCTACACGAAACCCATCGAAAT
CGAATTTTGATCGTTTCTACTTTCTGCCATTTGATTCTCTTCATCAG
TCAGATTTAGGGAAACCGAGAAGCCCTAATCTTTGATTCTTTAATCG
CCATGGCTAATAGCTCTTTCAAGTTGGAACACCCACTAGAGAGGAGA
CAAATTGAATCTTCTCGCATCAGGGAGAAGTATCCAGACAGAATTCC
AGTGATCGTAGAGAGAGCTGAAAGAAGTGATGTTCCCAATATCGACA
AGAAGAAGTACCTTGTTCCGGCTGATCTAACTGTGGGGCAGTTTGTG
TATGTTGTCCGTAAAAGAATCAAACTGAGTGCCGAAAAGGCGATCTT
CGTCTTTGTGAAGAACACATTGCCTCCAACTGCTGCAATGATGTCTG
CAATCTATGATGAGAACAAAGACGAAGATGGGTTTCTCTACATGACT
TACAGTGGAGAGAACACCTTTGGTTTGGTTTAAATGTGTGCCTTTCA
ATGCTTTTGTGCTTATGTGTATATTATATGCTCTTTTATAA

SEQ ID NO:418 25427 234014_301096_1
GGTCTGGTTCCTCTTTGCCGCGGCCACAGAGGGAGAGAGATCGATCG
GATATGAGTGGCAAGCAGGTCTCGGCTAAGAGCTCCTTCAAGCAAGA
GCATGATCTCGAGAAGAGGAAGGCCGAGGCTGCTACAATTAGGGCCA
AGTATCCATAGAGAATTCCGGTGATTGTGGACAAGGCTGAAAGGAGC
GACATCCCAAACATCGATAAGAACAAGTATCTAGTTCCAGCCGATCT
GACGGTCGGGCAGTTTGTCTACGTGGTTCGCAAGCGGATCAAGCTGA
GTGCGGAGAAGGCGATCTTCATCTTCGTAAATAACGTTCTTCCCCCG
ACTGCCGGAATCATGTCGGCAATCTACGACGAGCACAAAGACGAGGA
CGGTTTCCTGTACGTTACATACAGTGGGGAGAACACGTCCGGGCTTT
GTCTATGAAGATGAAGAAGCAGCGATGATCCATCCAGCAAAATTGCA
TCGA

SEQ ID NO:419 25427 199996_300754_1
TTCACTCCATCATCCCCGCTATCGATATTTATCGCTTTTATCGCCCT
CTGAATCGCCATCGATAGTCTCACAGCCGCACAACAACCAACCCGCT
GCACTTTCACTCTCATCACCCAACACTCTTAACCTTTCGGTTGCCGT
CAAGATGCGCAGCAAGTTCAAGGACGAGCACCCCTTCGAGAAGCGCA
AGGCTGAGGCCGAGCGCATCCGACAGAAGTATTCCGATCGCATTCCC
GTCATCTGCGAAAAGGTCGAGAAGAGCGATATTGCTACCATCGACAA
GAAGAAGTACCTAGTCCCCGCGG*ACCTGACAGTAGGCCAGTTTGTC
TACGTCATCCGCAAGAGGATTAAGCTTTCTCCAGAGAAGGCTATCTT
CATCTTCGTGGATGAGGTCCTTCCTCCTACTGCCGCTCTCATGAGCA
GCATCTACGAGGAGCACAAGGACGAGGACGGCTTCCTATACATCACC
TACTCCGGCGAGAACACCTTTGGTACCGCATAAACACCGAGGCGATA
CAGGGGAACTTTCCAAGCCGATGTGGCTGATGCAGGCGTTCTGGTCG
TTGGGCTTTTACTCTTTCCGATGGGGGATACTGGTGCTTTGTGATAT
TGCGAATTCATTGTTTTTATCAAACAAGAAG

SEQ ID NO:420 25427 188266_300689_1
CGATTCGCCCCCCGCCTCGATCGATCGATTCCGCGGGAGCGCCCCTT
CGATCGGTTGGAGATGGCCAGGACTTCCTTCAAGCTCGAGCACCCAC
TGGAAAGGAGGCAAGCAGAATCTGCCAGGATCCGTGAGAAGTACTCA
GACAGAATTCCGGTGATCGTTGAGAAGGCTGACAAGACCGATGTTCC
AGAAATTGACAAAAGAAGTACCTTGTCCCTGCTGATCTCACTGTTG
GCCAGTTTGTCTATGTGGTTCGGAAGAGGATTAAGCTTAGCCCAGAA

FIGURE 9x

AAGGCCATCTTTGTCTTTGTGAAGAACACATTGCCGCCAACTGCTTC
TTTGATGTCTGCAATCTACGAAGAGAACAAGGATGAGGACGGCTTCC
TCTACATGACTTACAGTGGCGAGAACACATTCGGCTCTGCGTAATTC
ATCAACTGTTGCTGCTGCTGTAAATAAACATGGATGGCCAGGTGTCA
TGGTCAACCTCCTGTGTACATAGCATGTCCCTGTGCTGGATTGCCTC
AATGGTCTAATGCGTCCTTAGCTTTTTAAGTGGTTCGTATGCTATCG
TTTGAAAGTTGGAACGACCCATAGAACTGATATTATTCATTCTGGGT
TGATGACGTTTCTTATTCTACCATTATGCATTT

SEQ ID NO:421 25427      174849_300527_1
AATTGTTCAATCCAAAGGGGAACCAGCACGCAAGCAACCAGCGAACC
CTAGCTACAGAGAGATTCGCATCAAGGAAGAAGACGAGAGAGGCTCA
TTTGAATTAGAGATAGAGATGAAGCCCAGGCCCTTCAAGGAGGAGTT
CACCTTGGAGGAGAGGGCCAAGGAGTCGGCCGCCATGATCGCCTCCT
ACCCCGACAGGATCCCTGTCATTGTTGAGAAATTTTCGAGGAGTAAT
CTTCCAGAAATGGAGAAGCGCAAGTACCTGGTTCCATGTAACATGCC
AGTTGGGCAGTTTATTTTCATACTTCGTTCCAGGCTACATTTGTCTC
CAGGGACAGCGTTGTTTGTGTTTGTCAACAACACTTTGCCCCAGACT
GCTCAGCTGATGGGCAGTGTGTATGAGTCATACAAAGATGAGGGCGA
TGGCTTCCTCTACTTGTGCTACAGCAGCGAGAAGACATTCGGTTGAC
CAACTCCTCCGTGGAGATCTGCTTTTACCTCGGGCATCAATAATATA
TGCATGTATATATATTACTATGATTAGAAATTACAATTATGTGTTTT
ATATACTGTATATTGATTGATG

SEQ ID NO:422 25427      155864_301360_1
TGAAGTCATTATTTCTGTTCTTTCAAAGGCGCTCCCTTTTTCTTTTG
TAAAACTAGCCAAATTGATCACAACCACTCTTCAATTCTTCGATTTT
CTTCTGTTTTGTTAAAGATCAAAGTTTGAGTCTTGTCATGGCCAAGA
GTTCTTTCAAGCTTGAACACCCCATGGAGAGGAGGCAGGCAGAGTCT
TCTCGTATCCGAGAGAAGTATCCTGATCGAATTCCGGTGATTGTTGA
GAAGGCAGAGAGGAGTGATATCCCTGACATTGATAAGAAGAAATACC
TCGTCCCAGCTGATTTGACTGTCGGACAGTTTGTTTATGTGGTTCGG
AAGAGGATCAAGCTCAGTGCTGAGAAGGCCATATTTGTCTTTGTCAA
CAACACTTTGCCTCCTACGGCTGCCCTGTTGTCTGCAATATGTGAGG
AAAATAAGGATGAAGATGGATTTCTCTACATGA

SEQ ID NO:423 25427      146977_301204_1
GATTGTACTTGAAGATGCGTGTCTGATGTTCATTATCCAATTATATA
GAGTACACTTTATTTTTTTTATTAACTTTAATAAACAAGAAAAAAT
TTGGTTGCTTCTTCACTCTCTTGTGATTTCCTTTGTTTTGCAGATAC
CCCAAATTTTTGGTTATCATTCTCCGATCACCATGGCCAAAAGCTCC
TTCAAATTGGAACATCCTCTTGAGAGGCGACAGGTTGAAGCTGCTCG
TATCAGGGAGAAGTACCCTGATAGAATCCCGGTTATTGTGGAGAAGG
CTGAAAGAAGTGACATTCCTGACATTGACAAGAAAAAGTATTTGGTC
CCCGCGGATCTGACTGTTGGACAATTTGTCTATGTTGTTCGTAAGAG
GATTACGCTCAGTGCTGAGAAGGCAATTTTTATCTTTGTGAAGAATA
TCCTCCCCCCTACAGCTGCAATGATGTCTGCCATTTATGAAGGAACA
CAAGGA

SEQ ID NO:424 25427      143594_200010_1
TTGTGAAGCAGGGAGATGGGGAAGGCTTTCAAAAAAGAATTTTCAGA
CGATGAGAGACTCGCAGAATCTCAAGATATAATCGCCAAATATCCTG
ATCGACTGCCGGTGGTGGTTGAAAGATATTCAAAGACTGACCTTCCT
GAGATGGAAAAGAAGAAGTACCTGGTACCCCGTGATATGTCCGTTGG
CCAATTTATCCACATTCTGAGTGGCAGACTCCATCTGGCTCCTGGGA

FIGURE 9y

```
AAGCTCTCTTCATGTTTGTGAATAACACCTTGCCTCAAACAACAAGC
TTGATGGAGACGGTGTATGATTCTTTCAAGGATAAAGATGGGTTCCT
CTACATGTGCTACAGCAGTGAGAAAACCTTTGGTCGTGCAAATAGTT
GAGCATATTGTCATTCCTAGGAAGTGCAACACATTGTGAACTAAAAT
ATGTAAATGGTATCTGTATTGCATGTCCGGCATACCTGTAAATTCTT
GCACTAGGGTGTCTATACTCTCAACTGTATATCTGAAGGAAATTCAA
ATGTTATTCTATCGTCCCTTGGAAAGAATaaAgaatacaaAggtTGC
AGT
```

SEQ ID NO:425  25427    1119055_301893_1
```
gggagaagaagaaggagaagccatgggtaggAGCTTCCAGTTCAAAC
AGGATTTCCCCTTTGAGACGAGGGTCGAGGAATCGGCCAAAATGAGG
CATAAATACCCCGACCGAGTACCCGTCATTGTCGAGAAAGCGGGAAG
AACAGATTTGCTGGATCTTGAAAAGAAAAAGTACCTTGTTCCAGAGG
ACCTTACAGTCGGGGAATTTGTTTATGTGATCAGACGGCGTCTACAA
TTAAGTCCGGACAGGCTCTGTTTTTCTTTGTCAATGATATTCTTCC
GCCAAACGCTAGTTTGATGTCTTCAGTGTACAAGAATCAGAAAGATA
AGGATGGATTCTTGTATATCAACTACAGTGGGGAGAAGACTTTCGGC
TCTATGGACCTTCCAGGTGTCCGCCCTTCATAACCTTCTTCTATTGT
GTTCACGTCCTGCTACATCTTGTATATAAACTTTGTATATAATGCCA
AAGCTTCTCAACAAATGGAAATTTGGCCAATTCGACATAGTATACTT
TATAACCAATATATTTCATGATAAATATATTATATGATTAATATATA
ACATGATAAACATATAACATGGCAGATATATTACATATCAAATATAT
TACACAATAAATATAttACGGAGTtaATATAttgcaTaATATAAATA
TATCTCCTgccAGtt
```

SEQ ID NO:426  25431    25466_301725_1
```
CAAACTTATTTGTTGTATCTAAATATATTACAAAGTTTCAACCCAAA
TTTACAATCTTCTCTGGAGAGATACTTCATAAAGCAAAAACCATAAA
GTTCTAATCAAGAGAATCTCACTCTACTTAATTAACAAAGATCTTTT
TTAAAACATCCTTCCAAGCTTTGTGATGAGTATGCTTCTTCAAGACT
TTTGATTCTGCTGTTTCTTGTTTTTAAAGTTTTAATAAGTTCCTCTT
TTAAGTTGGTTCTTGTGGACGAGCTGCCCAAAGAGAACTAAGAGCAC
GAAGTCTATGAAGATACTCTCCTAAAGCTAGTAAACCTCGAGCCGAT
TGTCTTGTCGTTAAGATCTTCGCCATTTGTTGCAAAGTTTGTTGCCT
CAGATGATCTGCTTGATTCACAAATCCTTCTAATGCTTGAAGATTCT
CTATAGCTGC
```

SEQ ID NO:427  27410    107937_300260_1
```
CAATTTACAGCCATGTTTAGGAGGAAGGCTTTCTTGCACTGGTACAC
TGGAGAAGGAATGGATGAGATGGAATTCACTGAGGCGGAGAGTAACA
TGAATGATCTGGTCTCAGAGTACCAGCAGTACCAAGATGCAGTAGCT
GATGAGGATGAAGGATATGAGGACGAAGAAGAAGCATATCATGAGTA
GTGAGCTAATAATGATGGGAAATCTCATCTTATATTTTAAGCAATAG
TTCTTTCAACTGTGGATGTAACCTCAACTACCATACCCATAGGAGGA
GATGAACTTCAGTAGTGAAGAGAAAGCGACTAACCTGTATTTTTGTT
GAACTTGTCACTATCCTTTAATTGCAAATTGAATATTTTGTTGCTTA
TGCTAAGATATCTGTGATTGGTTGATGAG
```

SEQ ID NO:428  27410    194490_300763_1
```
ccctgaaccacttgatcagtgctacaatgagtggagttacttgctgc
cttcgcttccctggtcaattgaactctgacctcCGCAAGCTGGCCGT
GAACTTGATCCCTTTCCCTCGCCTGCACTTCTTCATGGTGGGCTTTG
CGCCACTCACCTCGCGTGGCTCGCAGCAGTATCGCGCCCTCACTGTC
CCTGAGCTCACCCAGCAAATGTGGGACGCCAAGAACATGATGTGTGC
```

FIGURE 9z

CGCTGACCCGCGCCATGGCCGCTACCTCACGGCCTCCGCCATGTTCC
GTGGCAAGATGAGCACCAAGGAGGTGGACGAGCAGATGATCAACGTC
CAGAACAAGAACTCGTCCTACTTCGTCGAGTGGATCCCCAACAACGT
GAAGTCCAGCGTGTGCGACATCCCGCCGCGCGGCCTCTCCATGGCGT
CCACCTTCATCGGCAACTCCACCTCCATCCAGGAGATGTTCCGCCGC
GTGAGCGAGCAGTTCACCGCCATGTTCAGGAGGAAGGCCTTCTTGCA
TTGGTACACCGGCGAGGGCATGGACGAGATGGAGTTCACCGAGGCGG
AGAGCAACATGAACGACCTCGTCTCCGAGTACCAGCAGTATCAGGAC
GCCACCGCCGACGAGGCCGAGTACGAGGAAGAAGAGGACGCGATACA
GGAGTAGAGACTGTCTGGGCAATGGTACCTCGTATCCCCTGCCCATC
GTTACCCTAATATGTTTGCCTGAACATCATCGCAGTTGCATCACCAT
AGCTACCTCCGCACCTTAAAATTTGATGCTTgttTGTATGCATGTTT
GTACTGGTTCCGTATGCTAAAGTCTTGGCTATTGATGTTCTGTTTGC
TTGCTT

SEQ ID NO:429 27410    14468_300267_1
cccacgcgtccggcttaactctgaccttaggaaactcgctgtgaacc
ttatcccattcccaaggcttcacttcttcatggTTGGTTTCGCACCA
TTGACATCGAGAGGATCACAGCAATACAGTGCCTTGAGTGTTCCTGA
ACTGACCCAGCAGATGTGGGATGCAAAGAACATGATGTGTGCTGCTG
ACCCCGCCATGGGCGCtaccTCACAGCCTCAGCCATGTTCCGCGGA
AAGATGAGCACCAAGGAAGTTGATGAGCAGATGCTGAATGTCCAGAA
CAAGAACTCGTCATACTTTGTGGAGTGGATCCCTAACAATGTCAAGT
CGAGTGTGTGTGACATTCCACCCATTGGCCTGAAGATGGCATCCACA
TTCATCGGCAACTCGACCTCAATCCAGGAGATGTTCCGCCGTGTCAG
TGAGCAGTTCACCGCCATGTTCAGGAGGAAGGCTTTCTTGCACTGGT
ACACTGGTGAGGGAATGGACGAGATGGAGTTCACCGAGGCTGAGAGC
AACATGAACGACCTGGTAGCTGAATACCAGCAGTACCAGGATGCCAC
CGCTGAGGAAGAGGACTATGAGGAGGAAGAGGAGGACGAGGAGGTTG
CTGCCTAAGCCACCTCTCTGCATGTTTGAGCTATATAGATATCCCTT
GTGACATTTGCTACTACTAGTTACCATCGTTGATTGGGGGTGCTTGT
TAGATGCTAGGTTAATGTTATTATTTCCAAATACTATGTTGCCTTGT
CGGACTATTTTTATCTGGGTaatggtatgttccacattattgtctt
gaggtggattaactgttggaagtatgtagcaaagcttgaggtggaaa
aaaaaa

SEQ ID NO:430 27410    7395_300396_1
catgtgcttgaaaatagttttaaattttaatctcataaagctatatt
gttcaattataataattcaaaataaaaagcagTGTTTTTTAGTATG
AGGGAAATGTATCATGGAATGAAAAGCATTAAGTATAAAAAAATAA
TGGATTAATATACAGAATTTTTTTAAAATAAAAAGTAACAAAAAAT
GACATTTTAAAGCTAATTGTTTAAAAAAAGTCTAGTTTTCATCAACT
TCTTGTTCTTGTTCTTCATCAAATTCAGCTTCCTCATCAGCGGTAGC
TTCTTGGTATTGTTGGTATTCagaTACTAAATCATTCATGTTGGATT
CGGCTTCAGTGAATTCCATCTCATCCATACCTTCACCAGTATACCAA
TGCAAGAAAGCCTTACGCCTGAACATAGCAGTGAATTGTTCACTGAT
TCTCTTGAACAACTCTTGGATAGCTGTAGAGTTACCAATAAATGTAG
CAGACATTTTAAGACCTCTTGGAGGAATATCACACACTGCAGTTTTA
ACATTGTTGGGAATCCATTCAACGAAGTAGCTCGAATTTTTGTTCTG
AATATTTAACATTTGTTCATCAACTTCTTTCATGGACATACGGCCAC
GGAATACAGCTGCTACTGTTAGATAACGTCCATGTCTTGGGTCACAT
GCTGCCATCATGTTTTTGGCATCAAACATTTGTTGGGTAAGTTCGGG
AACGGTTAGTGCCCTGTATTGTTGGCTTCCACGAGAAGTAAGAGGAG
CGAAACCAGGCATGAAGAAATGTAACCTGGGGAAAGGAACCATGTTG
ACGGCGAGTTTACGGAGATCAGCATTCAATTGACCAGGGAACCTGAG FIGURE 9aa ACAAGTGGTCACTCCAGACATAGTCAAAGAGACTAAGTGGTTTAAGT
CACCGTATGTTGGTGTTGTAAGTTTTAATGTACGGAAGCAAATGTCA
TACAAGGCTTCGTTGTCAATACAGTAGGTTTCATCAGTATTTTCTAC
CAATTGGTGAACTGAAAGGGTAGCATTGTAGGGTTCTACAACAGTAT
CTGACACTTTTGGAGAGGGTAcaacagaatatgtgttcattattctg
tctgggtattcttcacggattttggagatcaataaggttccccggac
gcgtggg

SEQ ID NO:431 27410         284538_200099_1
AACCACTTGATTTCTGCTACAATGAGTGGGGTCACTTGCTGCCTCAG
GTTCCCGGGTCAATTGAACTCTGATCTTCGGAAGCTTGCTGTTAACC
TGATCCCCTTCCCTCGTTTACACTTCTTCATGGTTGGGTTTGCTCCT
CTCACTTCTCGTGGTTCACAGCAATACCGTGCACTAACAGTCCCGGA
GCTGACTCAGCAAATGTGGGATGCCAAAAACATGATGTGTGCTGCTG
ATCCACGCCATGGTCGTTACCTCACTGCCTCAGCCATGTTCAGGGGT
AAAATGAGCACTAAGGAAGTCGATGAGCAGATGATTAATGTTCAGAA
CAAGAACTCTTCTTACTTTGTTGAATGGATTCCAAACAATGTGAAAT
CCAGTGTCTGTGACATCCCACCCAGAGGTCTCTCAATGGCATCCACC
TTCATTGGAAACTCAACTTCCATTCAGGAAATGTTTAGGAGGGTGAG
CGAGCAGTTTACTGCTATGTTCAGGAGAAAGGCTTTCTTGCATTGGT
ACACAGGGGAAGGAATGGACGAAATGGAGTTCACAGAAGCTGAAAGC
AACATGAACGACCTTGTGTCTGAGTATCAGCAATATCAGGATGCCAC
TGCTGATGACGAAGGTGAATACGAGGAGGAAGAGTACGATCATGAAg
gCAACTGAAGaaaGACAtTTTATTATATGTGGTGTaaTACGTTTCTG
ATCTCCcagagaTATGAGcagttTTTTTCtTgtaTgttgCATCTTTG
CGTacacTTTGCTgtgAaGTc

SEQ ID NO:432 27410         202056_300722_1
CAAGCTGACCACACCTAGCTTTGGGGATTTGAACCATTTGATTGCTG
CCACCATGAGTGGAGTCACATGCTGCCTAAGGTTCCCTGGTCAGTTG
AACTCTGACCTCCGTAAGCTGGCAGTGAACCTTATCCCCTTTCCCCG
TCTCCACTTCTTCATGGTCGGATTCGCCCCGCTGACATCACGTGGCT
CCCAGCAGTACCGTGCCCTTACTGTTCCTGAGCTCACACAGCAGATG
TGGGATGCCAAGAACATGATGTGCGCTGCTGATCCTCGCCATGGCCG
TTACCTCACCGCCTCTGCCATGTTCCGTGGAAAGATGAGCACCAAGG
AGGTTGATGAGCAGATGATCAATGTCCAGAACAAGAACTCATCCTAC
TTCGTCGAGTGGATCCCCAACAATGTGAAGTCCAGTGTCTGTGACAT
TCCACCGAGAGGCCTCTCCATGGCATCGACCTTCATTGGCAACTCAA
CATCCATCCAGGAGATGTTCCGGAGGGTGAGCGAGCAGTTCACTGCT
ATGTTCAGGAGGAAGGCTTTCTTGCACTGGTACACTGGCGAAGGCAT
GGACGAGATGGAGTTCACCGAGGCAGAGAGCAACATGAACGACCTT

SEQ ID NO:433 27410         146038_301063_1
ttatatgatatttgtttcaggactttgaagctcactactccaagttg
gggtgacttgaaccatttgatctctgcaaccatGAGTGGTGTTACTT
GCTGTTTGAGATTCCCTGGTCAGCTGAACTCAGACCTGAGAAAGTTG
GCTGTGAATTTAATTCCCTTCCCACGTCTTCATTTCTTCATGGTGGG
CTTTGCACCATTGACCTCTCGCGGATCGCAGCAATACATTTCCCTCA
CAGTGCCAGAGCTTACTCAACAAATGTGGGATGCAAAGAATATGATG
TGTGCTGCAGATCCCCGTCATGGACGCTACCTGACAGCTTCTGCAAT
GTTTAGGGGAAAGATGAGCACAAAGGAAGTGGACGAACAAATGATCA
ATGTGCAGAACAAGAACTCATCCTACTTTGTTGAATGGATCCCTAAC
AATGTGAAGTCTAGTGTATGTGATATCCCACCAACTGGGCTTAAGAT
GGCATCCACATTTGTTGGCAATTCGACCTCCATTCAGGAGATGTTTA
GGAGAGTGAGTGAGCAGTTCACAGCTATGTTCAGGCGCAAGGCGTTT FIGURE 9bb TTGCATTGGTATACAGGTGAAGGTATGGATGAAATGGAGTTCACTGA
AGCCGAGAGCAACATGAATGATTTGGTTGCAGAATATCAACAATACC
AGGATGCTACAGCAGATGATGAGGAAGAGTATGAAGAGGAGGCGCT
GAGGAGCATTATGAATCTTAAAGACTTCTCTAAATTCAATATTGCTG
CTTTTGTCAAATTTCTGCCAAGTGGACTTGTTATTGtTTCTATTGTC
TTCTTTGCACTTGAACTTTCTGTTTTGATTTGGTGAGAATTGAATAT
TGAAATGTTTCTTAATGGTCTaaTtAtgagcaaTACtgtAttaCt

SEQ ID NO:434  27424      27482_300098_-1
TCTTCGAGATATTAATTAGTATGGTTCCATAGTTTTTGTCCGGTATA
CACATTTAAAACTAAACCAAAATCCGAACCGGACATTTTCTCTTACA
GTTAGGTATAACAAGAGAGAAAATGACATGTACAAGAAATGTGAAGG
AAGATTACATGGATTGGATTGCTATGAACATTGGTTTGGGTTCTGGT
CTAGTACCAGTTTTAGACTCCTTAACCGGGACTACTGCATCTGGAAC
TCTTTGACATATGTTCTTGATAGAAGGATCATCAGAGCCTTGAACT
GAACTCAGTCTTGGAGATGAAAAACTGTATCCTTCCTTATGCATTGC
CTCGTGGCAGCTTTCTTCTTCTTTGAACTTGATGAAGTAGATGGATG
ACCAGTAATCTCTTACCAAGTTCATCTTGATCAATTGCATGACTTCG
TTTAATGCGTTCTTGAAGAGATCAGTGTGAGTTAGATCTTGAGTGGT
TAAGATCTCTTGTCGGGTTTTATGAGATAAGTTCAATTCCATTTCCG
CTCCTGCGACGATGAACTTCTCCATGATATGTCGAGCCATGTAGATT
CTTCTTATCGAATCCGGACGCGTGGG

SEQ ID NO:435  27430      27434_300391_1
TGGGTTTTTGTTTTGAACTCTCCTTATGTATTACCGCCTCGCCGGAG
ACTGATACAGTTTCTTCTGTCCCTCATTGAAAGAAGAAAAGAAAACA
AAAATAGAAAAAAAAGAAAGCAGAAAAAAAGCCTAGGAGGAACAAT
GAATTTAGAAAACCAAACCATGACAGAAAAGTCTGCGGGATTCTCTG
GTTAGCTCTAGGTGATGATATGATCAAGTTTCGTCCTCACTGGCTTT
GTATGAAGGGAAAAGAAGATAATCTAAAAGATTCGCCAAAAGACACA
GATCGTTCACCGTGATGGCTCGCCTACAATATCGTGGTAAAACAAAA
ACGATTGTACTAAGTAGCAATTCCTCTGTTTGGTTGTCTCTTGTTCA
CACTGTAACTGCCAACATAACCTGGAGATGAACTTCTAGCTGAAACA
TCTGAAGAAGGAACCCCTCCTCCAATCCCATAGCTAAAAGGAGCAGG
CCCTTCTGTCTCAGGAGTTGGTGATCTCCATGTAGGGTCACTATAAA
CTGCACCATTCCCGTAAAACTCTGCAAGTCCTGCTGTATCATAACCC
GTGTTGTTGGTTGCTGAGGCAGAAGAGAATGAAGAGGATGGTGCTGC
cttgttagccctgggtttcttgctgcataaccacctgttcccaacc
caaaaccagattcaccgtttccggacgcgtggg

SEQ ID NO:436  27440      51409_300390_1
CCCACGCGTCCGCTCGGTGAGGCTGTCGGTGTTGAAGGGCTGGTTGT
CGGTCTGCGCGCTCAGCGCCAGCAGCGCGCGCCGCGAGAAGCAGGTA
CCGACACCGGCCGACGGCACCATGCCGGAAACACTTTCGCGCACCAC
CAGATCCTTGGCATGCCATTCGGCGAACTCGTCCATGTAGACGCCGG
CCACCAGTTCGTACCACTCGCGGTCCAGCGAGGTGACCGGCAACTGG
ATCATGTCCTTGCGCGGCAAAAGGTAGTTGTAGAAGCGCAGTTCCAT
CGGGTGCAGCACGTCCTCGCTGTCGTGCAGGATCACCCCGGCGAACT
CGATGTCGTGGCGCTTCTCGTAATCGAAGATGGCCAGGATCAGCCAG
TTCAGGCAGTCGGCCTTGCTGGTCGGCCCGTCATGCGGCACTTCCAC
GCGGCGCAGGCGCTTGTAGCGGCGGCGCATGCGCTCCACTTCGTCGA
TGGTCTGCTGGTCGTTGGGATAGGTGCCGACGAACACGACGTACTCG
CGGTAATCGAGTACGTTGATCATGTTCTCCACCATCTGCGCGATGAC
GTCGTACTCCATCCACGCCGGCaccatgatcgccagcggctgtt FIGURE 9cc

SEQ ID NO:437 27459      27494_300076_1
CCCACGCGTCCGACGATGTTGATCACAAGGGGCAAGAGATGGTAACA
ACAGTTTGCATGAAATGCCACATGCTGGTTATGTTGTGTACATCAAC
TCCTGTTTGTCCCAACTGCAAGTTCATGCACCCACACGATCACAGCT
CTACAAAACTGTTTAAACCATCAAATTTGCTTAGGCTTCTATGCTAG
GCTCTTTCAAGGTTACTGAATCTATAAAATTTGTACGGCAGATAATA
AGCCAAGAGACTAGATATGGACAAAGTTATGTATATACTAAAAGTAC
CAGAAAGTTTGTATTAATTCTCTGCTTCTATGAACGATCATGCTTTA
GATCTCTAAAAA

SEQ ID NO:438 27460      13658_300248_1
atagaaaaatctcaacatttcaattgggaaaatgggttctctacat
tcatacactgctgttcatcggaaagaaacaaggAAAGAAAACGACGG
TTAAAACTGAagaCCGTGTTCACGTGCTGCAGCAGCAAGAGCCTCAA
TACGTCCATGGTAAGGGTAACCACCACGGTCAAAGGCTACCTTTGTG
ATACCTTTCTCCAAGCAAGATTTTGCTATCACTTCCCCAACTTTCTT
CGCTACCTCAATGGTTGGTCCAGAGGTGTAGTCGAACTCTTCAGAGA
TTGGTTTCTGCTTAGTGGAAGCTGAAGCTAAGGTGTGCATCTTGGTA
TCATCAATCACTTGAACATAAAGATGCTTGTTTGATCGGAAAACACA
TAGCCTTGGCCTCTCCGTTGTACCATTAACCTTCTTACGGATACGAG
AGTGGCGGGCGATTCTGTCTTCGCTGCTGGTTTTGGTTTTGGCTTCG
ACAACCATGGACCGAGACTGAAGCGAAGAAGACGACCATGGTTTAAG
GAAAACGGCACGGTGTTGAAGTCCGTTTCCCAAGAACGCACTGCGGT
TAGTTATCAGACTCACTGAACCACACCCACTCACGCTCGTCATTCTC
TCTTACTCACTCTCTCTGGCTCGCTCTCTGTTCGTAAAAGCCTAGTT
CTAGATCGCGA

SEQ ID NO:439 27460      271252_200032_1
ggcgaaccaaaaaaGCCATGGCTTGTACTTCACTTTCACTTTCTTTT
CTTCACAACGCTTGCGCCGATAACAAGCAGCTGACTCTTCCATTCCG
TACCAAATTGGTGACGTCAGCTCGGCCTCTTACAGTTGAAGCCAAGG
CCACAACGAGACGGGAAGACAGAACTGCCCGACATGTTCGTATTCGG
AAGAAGGTTGAAGGGACACCTGAAAGACCAAGATTGTGTGTCTTCCG
TTCCAACAAGCACATCTATGTTCAAGTAATTGATGACTCCAAGATGC
ACACACTGGCATCTGCTTCAACAATGCAGAAACCAATCGCTGAGGAA
TTCGACTACTCCGCTGGCCCCACTACAGACGTGGCGAAGAAAGTTGG
GGAGGTTATAGCTAAGGCCTGTCTAGAGAAAGGAATCACTAAAGTAG
CCTTCGACCGAGGAGGTTATCCTTACCATGGACGGATTGAAGCTCTC
GCTGATGCTGCAAGAGAACACGGCCTTCAGTTTTAGAAAGTGCAGAT
TTCTTTCTTCTTCTTTTTTGTTGTGCAAATTACCTTTTCTGATCTTC
CCATTGGTTCCCAGTT*GTAAAACTCATGTCTAAGAAGTAAGATGAA
CTGGAGTTTAaATGTA

SEQ ID NO:440 27819      104479_300410_1
taacATTTCAAAGCAGAAAACCCTACAAGTCCGAAAGTTCTCTGAAT
TTTTCAAATTTCTCAATGGCACGTACCAAGCAAACTGCTCGTAAGTC
CACTGGTGGCAAAGCACCAAGGAAGCAACTCGCCACAAAAGCTGCTC
GGAAATCAGCTCCGGCGACCGGTGGAGTGAAGAAGCCACACAGATTC
AGGCCTGGAACTGTTGCGCTTCGTGAAATCAGAAAGTACCAGAAATC
AACTGAGCTCCTGATCCGTAAACTTCCGTTCCAGCGTTTGGTTCGTG
AGATAGCTCAGGATTTTAAGACCGATCTGAGGTTCCAGAGCTCTGCT
GTTGCAGCTCTTCAAGAGGCGGCTGAAGCATACCTTGTTGGTTTGTT
TGAGGACACTAACCTTTGTGCTATCCACGCTAAGAGGGTTACCATTA
TGCCTAAAGACATTCAGCTTGCCAGAAGAATTAGGGGCGAGAGAGCT
TAAATTAGTTTTTGGGTGTATAGTGGATTGTTTGTTAAGGGTTTTGA FIGURE 9dd GCCTTTTGTGTTTTGGTGTAGTACTTTCTCAGTTCTGGCTATGTAGT
TCAATGAAGTGCATTTTAATGAAATATCAGTACTATTTTATCca

SEQ ID NO:441  27819        109041_300042_1
tacaatcagagcatttctcaatctacaaaatggcccgtactaAGCAA
ACAGCTCGCAAATCAACAGGTGGAAAGGCTCCAAGGAAGCAGTTAGC
TACCAAGGCAGCGAGAAAGTCAGCTCCGGCGACCGGAGGAGTGAAGA
AGCCTCACCGTTTCCGTCCGGGAACTGTGGCTTTGAGAGAAATCAGG
AAGTATCAGAAATCAACAGAGTTGTTGATAAGGAAGTTGCCTTTCCA
GAGGCTGGTGAGGGAAATAGCACAGGATTTCAAGACAGATCTGAGGT
TCCAAAGCAGTGCTGTTGCTGCCCTGCAAGAGGCTGCTGAGGCTTAC
CTTGTTGGACTCTTTGAAGATACAAATCTCTGTGCCATTCACGCCAA
GAGGGTCACTATCATGCCAAAGGACATTCAGCTTGCTAGGAGGATTC
GCGGCGAAAGGGCTTAGAATGAAGCTTGTTATGCTTATGGTTATGGT
TAATTGTCTTCTCTGATCTTGGGCATCGTTTTAGTGTCTTTTGCTGA
ATATTAgggTTAGCGATGTAAATCAAGTGACTTgttTCAATCAAAGT
ATATGTAAAACCTCTAATTAGTACTTTGAATTCTTATTAaTGAAATT
TgtcgttcATtttG

SEQ ID NO:442  27819        126687_300465_1
gccattacggccgggggacagaacaaaagaagagaagaaggagaaaa
agaaaagatttaatacgagATGGCTCGTACCAAGCAAACTGCTCGTA
AGTCTACAGGAGGAAAGGCTCCAAGGAAGCAACTTGCTACTAAGGCT
GCACGCAAGTCCGCTCCTACCACTGGCGGTGTGAAGAAGCCACATAG
ATACCGCCCTGGTACTGTTGCTCTTCGTGAAATCCGTAGGTACCAGA
AGAGTACTGAGCTCTTGATCAGGAAGCTTCCATTTCAGAGGCTTGTT
CGTGAAATTGCCCAGGACTTTAAGACTGATCTGCGTTTCCAGAGTCA
TGCGGTGCTGGCTCTGCAGGAGGCTGCTGAGGCCTACTTGGTGGGTC
TCTTTGAGGACACTAACCTTTGTGCCATTCATGCCAAGCGTGTGACA
ATTATGCCTAAGGACATTCAGCTTGCCAGGCGAATCAGGGGCGAGCG
TGCTTAATTTGATCTACtaGCTTGTAGCGTTGGTGTGATCCTtgtcT
TTCTTTTCTTTGTAAGACGTAAAGACAGTAACTAAATCTAGTAGTAG
GGCTtgttgCTTTTAATTTGCtGGTGGCTggtggtgtGCTGTAATTT
CTTGGTGTTTTCTTTTGGAGAAGGGGGAAAACATGCTAttTTGTTTG
gaTCTCTAAt

SEQ ID NO:443  27819        144294_200133_1
cccacgcgtccgCAAACACTCATATATTCTTTCATCCAAATCCTTTG
AGCCCTAATTCCCAAATGGCTCGTACAAAGCAAACTGCCCGAAAATC
CACCGGAGGGAAAGCTCCGAGAAAGCAATTAGCCACAAAAGCTGCCA
GAAAGTCAGCTCCGGCCACCGGGGAGTGAAGAAGCCTCACAGATTC
AGGCCAGGGACTGTTGCGCTTCGTGAAATCCGCAAGTACCAGAAATC
AACTGAGCTTTTGATCCGTAAGCTCCCGTTCCAGCGTTTGGTTCGGG
AGATAGCTCAGGACTTCAAGACCGATCTCCGTTTCCAGAGTTCGGCT
GTGGCTGCGCTCCAGGAAGCTGCTGAGGCTTATCTCGTCGGTTTGTT
TGAGGACACAAACTTGTGTGCTATTCATGCTAAGAGGGTTACTATTA
TGCCTAAGGATATTCAGCTTGCTAGGAGAATTAGGGGTGAGAGGGCA
TAAGTGTGAACCTACGGTAGCTATGGGAGCTTGTAACTGAGCATATG
GTAGATGAGTTTCTAGGCTTTTACTGTATTTGGTCCAAAATTTTCT
CAATTCTGGATATGTAGTCGTATTAAAAGTATTTTAATGAAATATCA
GTTCTTCTTTgc FIGURE 9ee SEQ ID NO:444   27819        14402_300267_1
cccacgcgtccgcttcatcaaATCTCACAAATCTTCAACACTTAATC
ACAAATCTCAAAGCTTCGGATACCAAATGGCTCGTACCAAGCAAACC
GCAAGGAAATCCACCGGAGGAAAAGCCCCAAGGAAACAACTCGCAAC
AAAGGCGGCGAGGAAATCAGCTCCGGCGACCGGAGGAGTAAAGAAGC
CACACAGATTCCGTCCTGGAACTGTTGCCCTAAGAGAAATCAGGAAG
TATCAGAAGAGCACTGAGCTTCTGATCCcgtaagctaccgttccagc
gcttggttcatgagAtcgcttcaggAtttcagaacAAATCTGcattt
ccagaGcaacgccgtttgcagcacttcacgtaagcggctgaagcata
CcttgttgGATTGtttGAagaCACCAATCTTtgcgcgaTtcatgCtA
ATagagtcaCTATCATGCCTaaggAtATtcaattggcgaggagaatt
agaGGCGAGAGGGCTTAaGAAGGAgattgaagtaCtctatactgTGA
TcgctATGCttatgtaTATCTTtcgttttcCCTAaT SEQ ID NO:445   27819        6855_300313_1
CCCACGCGTCCGCAAGAAGAAAATTCGATCGGTCGATTAGTCTTTGT
TTGATTTCGAAATGGCTCGTACTAAGCAAACCGCGAGGAAATCCACA
GGAGGCAAAGCACCAAGAAAGCAACTCGCAACCAAGGCGGCAAGGAA
ATCTGCTCCGGCCACCGGAGGAGTGAAGAAGCCGCATAGATTCCGTC
CAGGAACTGTTGCCTTGAGAGATCAGGAAGTATCAGAAGAGCACT
GAGCTTCTGATCCGTAAGCTTCCTTTCCAGCGTCTGGTTCGTGAGAT
AGCTCAGGATTTCAAGACGGATCTG SEQ ID NO:446   27819        6576_300328_1
cccacgcgtccgCAAAACTCGCTTCCTGATAATCAAATCAAAAGCTT
CTCTATCAAGCTTATCGAAAAGTCACATCTTTTGGAAGAAACAATGG
CTCGTACCAAGCAAACCGCTAGGAAATCCACCGGAGGTAAAGCTCCC
AGGAAGCAGCTTGCCACCAAGGCGGCGAGGAAATCAGCACCAACCAC
CGGAGGAGTCAAGAAGCCTCACCgttACCGTCCAGGAACCGTCGCTC
TTCGTGAGATTCGTAAGTACCagAAGAGTACTGAAttgttgATCCGC
aaGCTTCccttccagCgtctc SEQ ID NO:447   27819        51555_300088_1
TTTGCttggaATTAATATTATAACcCTTGGATTTAACTTGAAATTTT
ACAATCTTATGGTTCTAATCAAAACACAAGAGTAACCAGAATACTTA
GATCTAAGCTCGTTCTCCTCTGATTCTTCTCGCGAGCTGGATGTCCT
TGGGCATGATCGTGACCCTCTTGGCGTGAATGGCGCAGAGATTGGTG
TCTTCGAAGAGTCCGACGAGGTAAGCTTCAGCAGCTTCCTGAAGAGC
GGCGACGGCACTGCTCTGGAAACGAAGATCGGTTTTGAAGTCCTGAG
CGATCTCTCTGACAAGCCTCTGGAAAGGGAGTTTACGGATAAGAAGC
TCAGTGCTCTTCTGGTACTTCCTGATTTCTCTTAAAGCAACAGTTCC
GGGTCTGAATCTGTGTGGCTTCTTCACTCCTCCGGTGGCCGGAGCAG
ATTTCCTCGCCGCTTTTGTCGCCAGCTGCTTCCTTGGAGCCTTTCCT
CCGGTTGATTTCCTAGCCGTCTGCTTGGTACGAGCCATGAGGTAAAA
TGTTATTAAGAAACTGTTTGATTTTAATTTGAAGATGAGAGAAAGTT
GCGGACGCGTGGG SEQ ID NO:448   27819        317134_301452_1
tgCttttggccacagacctactCACGAttggcagtTgatcacaagcC
TCTTCCGCAATGGAGCAtggCATTCCACAACTGTGTCCAACGATTCC
ATTCAGGGCGCATTTTTGCGGTTCCAATAGATACTTCTTGTAAAGTT
CCAATCTCTTATTTCTTGTTTCAGAATATACATGCTTTCGCTCACAT
CTCTTACCACAGTAAGTACTTGTAGTTAAGGTACCACAACACACACA
AGAGAAAGTAGCCATTCTAGACCTAGGACCAGGGTTAGATTCCACGT
CACCCGCCAACTTCAGCAAATCAAAATTCAACAGCTGTTTGTAGAGC FIGURE 9ff TCGGCATAATCCGGAACATCATACGGATAAGCGGCCGCACCGCGCTC
ACCACGGAGGCGGCGGGCCAGCTGGATGTCCTTGGACTGGATGGTGA
CACGCTTGGCGTGGATGGCGCAAAGGTTGGTGTCCTCGAAGAGGGAG
ACGAGGTAGGCCTCAACGGACTCCTGGAGAGCGCCGATGGCAGAGGA
CTGGAAGCGGAGATCCGACTTGAAGTCCTGAGCGATCTCACGGACAA
GACGCTGGAAGGGCAGCTTGCGGATGAGAAGCTCGGTAGACTTCTGG
TAACGACGGATCTCACGGAGAGCGACGGTACCAGGCTTGTACCTGTG
GGGCTTCTTGACACCGCCGGTTGAGGGGGCGGACTTGCGAGCAGCCT
TGGAGGCGAGCTGCTTACGGGAGCCTTGCCACCAGTGGACTTACGG
GCGGTCTGCTTAGTGCGAGCCATGCTTAATTAATGCGAAGGTAAATA
CAGTAGATTTAAACATCAGGACCTAGAGTTCACCACTCGAAGTCTTT
TCTCAGCTTCTTATCCACAAATTTCCCTTCACAATTAAACAGCAACT
TAAACTTATTAAAGTCAAAGATATGATAACATAAAGAAACCAAAGCA
GAAATAGCACTATAAGGGGATCGATATCTATCCACTAAAGCCTTATC
CAAAGCATCAAGCACCTTAAAGTCTTTGTAAGATTTGTAATTGTCAT
TGATAGAGATATAAATCTCACTCAAAACTTCTACATCTCTCACATCA
GTTCTACCTAAttttgtgAtAAAt SEQ ID NO:449 27819      280727_200068_1
ATTCTCTCTCTAGAAACTGTACTCTTTCTTTCTCTAGAAGATCTG
AAGCAATGGCAAGAACAAAGCAAACAGCCCGAAAATCCACAGGAGGA
AAGGCACCAAGGAAGCAATTAGCCACAAAAGCCGCAAGGAAATCAGC
ACCAGCAACAGGAGGAGTGAAGAAGCCTCACCGTTTCCGCCCTGGTA
CAGTGGCTCTTCGTGAGATCCGAAAGTACCAGAAGAGCACTGAGCTT
TTAATCCGAAAATTACCTTTTCAAAGACTGGTCAGAGAAATTGCACA
GGATTTCAAGACGGATCTTAGGTTCCAGAGCAGTGCTGTAGCTGCAC
TACAAGAAGCTGCTGAGGCTTACTTGGTGGGTCTCTTTGAGGATACA
AATCTGTGTGCTATTCACGCTAAAAGGGTGACTATTATGCCTAAGGA
TATTCAGTTGGCTAGGCGTATTAGGGGTGAAAGGGCTTAATGTTTCA
TTGTTGTGTTTTTTGTGTTTAGGGTTATGGTGAATGTGGTATG SEQ ID NO:450 27819      236373_301249_1
acttgacttagggttcttcgcgctagggttcttCGATCGTCTTCTCT
TCGAACCGGCCATGGCGCGTACCAAGCAGACCGCTCGCAAATCCACG
GGAGGCAAGGCGCCCAGGAAGCAGCTCGCAACCAAGGCTGCCAGGAA
ATCCGCTCCCACCACCGGAGGAGTGAAGAAGCCCCATCGCTACCGCC
CAGGAACAGTCGCTCTTCGTGAAATTCGCAAGTACCAGAAGAGCACT
GAGCTCCTCATCCGAAAGCTTCCCTTCCAGAGGCTTGTTCGCGAGAT
CGCTCAGGACTTCAAGACCGATTTGAGGTTCCAGAGCCATGCGGTGC
TGGCCCTCCAGGAGGCGGCGGAGGCGTACCTGGTGGGACTGTTCGAG
GACACCAATCTGTGCGCGATTCATGCCAAGAGGGTGACCATCATGCC
CAAGGACATCCAATTGGCTCGCCGGATCCGTGGAGAGAGGGCTTAAG
AGATTCATCAATCTTAAGAAAACTAGCTTCACCAATGTAGATACTAC
TACTACTACTACTAATCCCTCTGTTTGATTTGATTTCAGTGCAAATG
CAAAGTCTTCTGGTTGTTTGT SEQ ID NO:451 27819      235081_301223_1
GGAAAGATTTCGTCGCGCTAGGGTTTTCTGATTCGTCGTCCATGGCG
CGTACTAAGCAGACTGCTCGCAAGTCCACGGGAGGCAAGGCGCCGAG
GAAGCAGCTCGCGACCAAGGCCGCCAGGAAGTCGGCTCCCACCACCG
GTGGAGTGAAAAAGCCCCATCGGTACCGCCCGGGAACAGTCGCTCTT
CGTGAAATCCGCAAGTACCAGAAGAGTACCGAGCTGCTCATCCGCAA
GCTGCCCTTCCAGAGGCTTGTGCGTGAGATTGCTCAGGACTTCAAGA FIGURE 9gg CGGATCTGAGGTTCCAGAGCCACGCGGTGCTGGCGCTGCAGGAGGCG
GCGGAGGCATACCTGGTGGGTCTTTTCGAGGACACGAACTTGTGCGC
GATCCATGCCAAGCGGTGACCATCATGCCCAAGGACATCCAGTTGG
CTCGCCGCATTCGTGGAGAGAGGGCGT SEQ ID NO:452    27819    218588_300919_1
ACCAAGTCTTTTTTTCAAGCATCTTCACAGTCAACACATCACAACAAC
TCATCATGGCCCGCACCAAGCAGACCGCCCGTAAGTCCACTGGTGGC
AAGGCTCCCCGCAAGCAGCTCGCTTCCAAGGCTGCCCGCAAGAGCGC
TCCCTCCACCGGAGGTGTCAAGAAGCCTCACCGTTATAAGCCTGGTA
CCGTCGCTCTCCGTGAGATTCGACGATACCAGAAGTCGACTGAGCTC
CTGATCCGCAAGCTCCCCTTCCAGCGTCTGGTCCGTGAAATCGCTCA
GGACTTCAAGAGCGATCTCCGCTTCCAGTCTTCTGCCATCGGCGCCC
TCCAGGAGTCCGTCGAGTCTTACCTCGTCTCCCTCTTCGAGGACACC
AACCTTTGCGCCATCCACGCAAAGCGTGTCACCATCCAGAGCAAGGA
CATCCAGCTCGCCCGCCGCCTCCGTGGTGA*GCGCAACTAAGTTGGA
GAGACTTTGGGAGGAACGTTGCAGACATGACTTTTGCTTTTCACACG
AGTGTTTCTGGGG*TCAAGGGATAATCAGGCGTTACAAATGAGAGTT
TTTATTCCCCTTTATGGTTCGGAATGTATATTACCAGTGCGTCAGGG
AAAAAGCACTGCATAAATGCAAACGAGGTTCACGGCCTCACGGGTTA
ACGAACTATAATAACTGCATCACTCTAAAAAAa SEQ ID NO:453    27819    183522_300623_1
CAAATCCAAAGAAATCACTCGCCGCCGCCGCCTCGCCTTCTCCGCCG
CGCCAAGCTCTCCTCTCCTCCTCCTCGATGGCCCGCACGAAGCAGAC
GGCGCGCAAGTCCACCGGCGGGAAGGCGCCGAGGAAGCAGCTGGCGA
CCAAGGCGGCGCGCAAGTCGGCCCCGGCCACCGGCGGCGTGAAGAAG
CCCCACCGCTTCAGGCCCGGCACCGTCGCGCTCCGTGAGATCCGCAA
GTACCAGAAGAGCACGGAGCTGCTCATCCGCAAGCTCCCCTTCCAGC
GCCTCGTCCGCGAGATCGCCCAGGACTTCAAGACCGACCTCCGCTTC
CAGAGCTCCGCCGTCGCCGCGCTGCAGGAGGCCGCCGAGGCGTACCT
CGTCGGGCTGTTCGAGGACACCAACCTGTGTGCCATCCACGCCAAGC
GCGTCACCATCATGCCCAAGGACATCCAGCTCGCGCGCCGGATCCGC
GGCGAGCGCGCTTAGGCGATCCGCCCTCCTTTGGTTCTTGCTTGGTT
CGTAGGGACTTGTCATGttCTACCAGTTCTTGttAATTATTAGATCC
TTGccTTGTCATGTCGT SEQ ID NO:454    27819    175601_300543_1
cccccccacTGTTCGCCTTTCCACGCCAGTTTGGTCGCTCTCGATTT
CGATTTCCCCCAAATCCACCGCAAGAGCCAAGTCGCCGCCGAGAAGC
GAAGAGGAGATGGCCCGTACGAAGCAGACCGCCCGCAAGTCCACCGG
CGGCAAGGCCCCGAGGAAGCAGCTCGCCACCAAGGCGGCGAGGAAGT
CTGCTCCGACCACCGGCGGCGTGAAGAAGCCCCACCGCTACAGGCCG
GGGACGGTGGCGCTCCGCGAGATCCGCAAGTACCAGAAGAGCACGGA
GCTCCTGATCCGCAAGCTCCCCTTCCAGCGCCTCGTCCGCGAGATCG
CGCAGGACTTCAAGACCGACCTCCGCTTCCAGAGCCACGCGGTGCTC
GCCCTCCAGGAGGCCGCCGAGGCCTACCTCGTCGGTCTCTTCGAGGA
CACCAACCTCTGCGCCATCCACGCCAAGCGCGTCACCATCATGCCCA
AGGACATCCAGCTCGCCCGCCGCATCCGCGGCGAGCGCGCGTAAGCC
GCCGCCTTCGACGCGGTTGCGTTGCGTAGCGCCGAAGCGATCTGGGG
GGATCAACGACGACGACGTGACGTGGTCAACTTGTTGATTCCCTCT
CGCTTCcGCGTTTTAGATCTCGTTTTCATTAGCAGCTTTGTAATAGG
GTTTGGTCGGTTAATTAGTgTaAAAACAGGGTTCGgTTAAAGActca
aAATcaaatgttA

FIGURE 9hh

SEQ ID NO:455 27819      156572_301367_1
cccacgcgtcCGCACAAAAGCAGATAGAAGAAAGAAGAAGGAGAAAA
GAAAAAAGAGAAGATGG*CTCGTACCAAGCAAACTGCTCGTAAGTCT
ACCGGAGGAAAGGCACCTAGGAAGCAACTTGCTACTAAGGCTGCTCG
TAAGTCTGCTCCTACTACTGGTGGAGTAAAGAAACCTCACAGATACC
GCCCTGGTACTGTTGCTCTTCGTGAAATCCGTAAGTACCAGAAGAGT
ACTGAGCTCCTGATCAGGAAGCTCCCATTCCAGAGGCTTGTTCGTGA
AATTGCTCAGGATTTCAAGACTGATCTGCGTTTCCAGAGTCATGCTG
TGTTGGCTCTTCAGGAGGCTGCTGAGGCATACTTGGTTGGTCTCTTT
GAGGACACAAATCTTTGTGCCATTCATGCCAAGCGAGTCACCATTAT
GCCAAGGACATTCAGCTTGCTAGGCGTATCAGGGGCGAGCGTGCTT
AATTTGATAAAGTGTGGTAGCTTTGTTGGTGCTTTTAGATCTTTTTG
TTAAAAGACTGATGGTATTAAAATTTAGTAGTAGGGATGATATGCTA
TGTTGATCTTATAGTGTGGTGGATGGAGGTGGTGAAACATAGTATAT
GTTGGATCTTTCTAATGtTTGtTGTCACACCGCTGGTGTTGAACAA
GTTTCAGAATTTGCATCTAATGTTTAGTTCAACTCTATGGT

SEQ ID NO:456 27819      155514_301357_1
TTCCTCTTCTCCTTCTGTAGTTTCCTCTCTAATTTCAAGGTTTCCT
CACACCCTTCAAACTCGAGCAATCTTAAGGAACTCAGATGGCTCGT
ACGAAGCAAACGGCTCGTAAATCTACTGGAGGCAAGGCTCCAAGGA
AGCAGCTTGCAACCAAGGCTGCCCGTAAGTCTGCCCCAACAACAGG
AGGAGTTAAGAAGCCTCACAGATACAGACCTGGAACCGTTGCTCTT
CGTGAAATTCGCAAGTACCAGAAGAGTACTGAGCTGTTGATCAGGA
AATTGCCATTCCAAAGGCTTGTTCGTGAAATTGCACAGGACTTCAA
GACTGATTTGCGTTTCCAGAGTCACGCTGTATTGGCTTTGCAAGAA
GCAGCTGAGGCCTACCTTGTTGGATTGTTTGAGGACACAAATCTGT
GCGCCATTCACGCCAAGCGTGTCACTATCATGCCCAAGGATATCCA
GTTGGCCCGAAGAATTAGGGGAGAAAGAGCTTAGAATGATCTGTTC
TGCCGTATCGTGCTTAGATTGTTGATTTTTTTTTGAATTGCCGTC
TTTCTGCATTTTTCTTCTTCTTTgttCTTCATATAGGTAGTTTTA
CTAGATATGAATGGCTGTGGCATACTGGAAATTTGATActcTCTAt
tATATAGTCGAattTTattggTATT

SEQ ID NO:457 27819      155031_301352_1
cccaCGCGTCCGCAAAGTCTTTCACATTATCATAATATATTCGAAA
TGGCTCGTACCAAGCAAACTGCCCGCAAATCCACTGGTGGAAAGGC
TCCAAGGAAGCAGCTAGCTACCAAGGCCGCGAGAAAGTCAGCTCCA
GCGACCGGAGGAGTGAAGAAGCCTCACCGTTTCCGTCCAGGAACTG
TTGCTCTCAGGGAAATCAGGAAGTACCAGAAGTCCACTGAATTGTT
GATAAGGAAGCTGCCATTTCAGAGGCTGGTGAGGGAAATAGCACAA
GATTTCAAGACAGATCTGAGGTTCCAAAGCAGTGCTGTTGCTGCTC
TTCAAGAGGCTGCTGAGGCTTACCTTGTCGGACTCTTTGAAGATAC
CAATCTCTGTGCTATTCACGCGAAAAGGGTCACCATAATGCCAAAG
GACATTCAGCTTGCTAGGAGGATTCGTGGAGAAAGGGCCTAGAATG
ATGCTATGTTAATCTTATGGTTATTGTTAATTTTGTGTTCTTCTGA
TTTAGGGCTGCTTTTTTCTGTCGTTCGTGGAATGTTAGGGCTAGTG
ATGTAAATCAAATGACTTGTTTCCGTCAAACTATATGTAAAACCTC
TGGTTTACCAGTATTCTAAGATTTGATCAATGAAATCTACGTTCAT
TTCCTTTCAATC FIGURE 9ii

SEQ ID NO:458 27819      254085_301631_1
accacgcgtcgcttttcttctatctttgccatcctcgttctggtt
ttggtagacagacaagaatggctcggacaaagcaGACCGCTCGTAA
GTCGACCGGGGGGAAGGCGCCCCGGAAGCAGTTGGCCACCAAGGCA
GCTCGCAAGAGTGCCCCTGCCACAGGTGGAGTGAAGAAGCCCCACA
GGTTCAGGCCTGGAACTGTTGCCCTTCGTGAGATTCGCAAATACCA
GAAGAGTACTGATCTCTTGATCCGAAAGCTCCCCTTCCAACGCttG
GTTCGTGAgatagctCAAGACTTCAAGACTGATCTCCGATTCCAAA
GCTCTGCTGTCTTGGCCCTGCAGGAGGCTGCTGAAGCATACCTAGT
GGGTCTCTTTGAAGACACAAATCTCTGCGCTATTCACGCCAAGAGA
GTGACAATCATGCCTAAGGATATTCAGCTGGCCAGGAGAATCaggg
ggGAGCGTGCCTAAGTAAATATTCCTGACCTTACCTTCTTAACGGT
GTATTTGTACACCACAttttgcCtttgaAAGTTAcattttTGGTCTA
GTAATCTATTTCTCTGTTTcAgTGGGCATTACTAGTGATGCCTAGG
CTGATGGGATGATCACTTAGTGATGATAACCttggtAcattttgat
TcatgttgtaAgtttAgAGCatCCGATTT

SEQ ID NO:459 27819      252932_301610_1
ATAATTTTGGCGGGGTTTGGAACTGCGATTTGGAATTCCTCCTGCA
CTTCGACGACTTCTGATTTCCTGCGATGGCTCGTACCAAGCAGACA
GCTCGTAAGTCTACTGGTGGAAAGGCACCCAGGAAGCAGCTTGCTA
CTAAGGCTGCAAGGAAATCTGCTCCCACTACTGGCGGAGTAAAGAA
GCCCCACAGATACAGGCCTGGAACTGTTGCTCTTAGAGAGATCCGC
AAGTACCAGAAAAGCACAGAGTTGCTGATTAGGAAGCTTCCTTTCC
AGAGGCTTGTTCGTGAGATTGCCCAAGATTTTAAGACTGATTTGCG
GTTTCAAAGCCATGCTGTGCTGGCATTGCAAGAGGCAGCAGAGGCA
TACCTGGTTGGACTCTTCGAGGACACCAACCTCTGTGCCATCCATG
CGAAGAGGGTCACCATTATGCCTAAAGATATCCAGCTTGCCAGGAG
GATCCGTGGGGAGAGAGCTTAACCCGTCTTTTGCTGAAAGAACTGT
AGTTATTTTAGTTATTTAATTGTTGTCATCTTGTCTTGTGCTCGAA
GTAACTGCCTTGTTACTTTGCTGTTGGGCTCGTTCCCAAGAAACTT
GTGGTCTTATTGGCCAATTGTACTAGCTTAATATACACTGCTTGTT
TTTGAACAATGT

SEQ ID NO:460 27819      144859_200137_1
agtaaaacaccacatcccaagtcaatacacattaacccagccatac
aaacgactccaaaacaccaaccaaaatcacaactTTCACAGcaTTC
TCGACCTTCTCCCCTCTTGCAAAAAATCCTTTAAAAATGGCAAGAA
CAAAACAAACAGCACGTAAATCCACTGGAGGAAAGGCACCAAGGAA
GCAACTCGCAACAAAAGCTGCAAGAAAATCAGCTCCGGCAACCGGA
GGAGTGAAGAAGCCCCACCGTTTCCGTCCAGGTACGGTGGCACTTC
GAGAGATCCGTAAGTATCAGAAGAGTACTGAACTTTTGATCCGTAA
GCTCCCTTTTCAGAGACTGGTAAGAGAAATAGCGCAGGATTTTAAG
ACTGATTTGAGGTTCCAGAGCAGTGCTGTGGCGGCGCTTCAGGAAG
CAGCAGAGGCGTACTTGGTGGGTTTGTTTGAAGATACCAACTTGTG
TGCTATCCATGCTAAGAGGGTTACCATTATGCCTAAGGATATTCAG
TTGGCTAGGCGGATTAGaGGTGAAAGGGCTTAGTGTACTTTTGTTT
GCAATTGGATTTAGTTTTTAGGTTGTCTTTTTGTTGTAATGTAATG
AACTATTTGATAAAGAAAATCTGGAAAAGATTGCTggTTGATGGTA
AAGTgttAATTTCTTCAGCTAATTATTTAATCTTACCTTATTTT FIGURE 9jj SEQ ID NO:461 27819          142550_300436_1
cccccccgaattttTTCTGCGGTTTCTTCTTCTTCTTCCTCCTCCTCG
CGCTCCCCCGATTCGAAGCGTGAAGAGAGGAACGGCGCTTGCGAGA
GGAGAGAGATGGCCCGTACCAAGCAGACCGCTCGTAAGTCCACAGG
AGGAAAGGCTCCCAGGAAGCAGCTTGCCACCAAGGCTGCTCGTAAG
TCTGCTCCCACCACTGGAGGAGTTAAGAAGCCCCACCGTTACCGCC
CTGGAACTGTTGCCCTCCGTGAGATTCGCAAGTACCAGAAGAGTAC
TGAGCTTTTGATCAGGAAGCTGCCCTTCCAGAGGCTTGTTAGGGAA
ATTGCACAGGACTTCAAGACCGATCTGCGTTTCCAGAGCCATGCTG
TCCTTGCCCTCCAGGAGGCTGCGGAGGCATACCTTGTTGGTCTCTT
CGAGGACACCAACCTGTGCGCCATTCATGCCAAGCGTGTGACCATC
ATGCCTAAGGACATTCAGCTGGCTAGGAGGATTCGTGGTGAGAGGG
CTTAAATTCCCCTCGGCGATTCCTTTGACAAATGAAGCATGCGTCG
TAGTGTTAGTAGTGGGTTTTAATCTTTTGCTTATAAGAACAATCTG
AGTAGGGTGTATTTTGTGGAACAATATGTTTCTCTCTGTGACATGA
TGGTGCTGTATTCGTCTTATTGGTGGATCTGTCAAAAATACTCa SEQ ID NO:462 27819          127804_300473_1
AAAGCAGAGAGCAGAGAGCAGAGAGAAGAAAGAAGAAGAAGGAGAA
CAAGAAAAAGAGAAGATGGCTCGTACCAAGCAAACTGCTCGTAAG
TCTACTGGAGGAAAGGCACCTAGGAAGCAACTTGCTACTAAGGCTG
CTCGTAAGTCTGCTCCTACTACTGGTGGAGTAAAGAAACCTCACAG
ATACCGCCCTGGTACTGTTGCTCTTCGTGAAATCCGTAAGTACCAG
AAGAGTACTGAGCTCCTGATCAGGAAGCTCCCATTCCAGAGGCTTG
TTCGTGAAATTGCTCAGGATTTCAAGACTGATCTGCGTTTCCAGAG
TCATGCTGTGTTGGCTCTGCAGGAGGCTGCTGAGGCTTACTTGGTT
GGTCTCTTTGAGGACACAAATCTTTGTGCCATTCATGCCAAGCGTG
TCACTATCATGCCAAAGGACATTCAGCTCGCTAGGCGTATCAGGGG
CGAGCGTGCTTAATTTGATCAAGTGTGGTAGCTTTGTTGGTGCTTT
AGATCCTTTTCTTAAAAGACTGATGGTATTAAAAAATAGTGGTAGG
AACGATGTTCTATGTTGATCTTATTTTGTGGTGGATGGAGGTGTGC
TGTAATTGTTGTTCTGTTTGGGGAAGTGGAGAAACATAGTACTTGT
TGAATCTTTCTAATGTTTTATTgtcACACCACTggTGTTGAACAAG
TTTCAGaaTTTGCATCTAATGTTTagtTCAaCTgTTTgg SEQ ID NO:463 27819          126252_300461_1
aaaacttttatattattatcaaacattcgaaatggctcgtaccaaa
caaactgctCGCAAATCCACTGGTGGAAAGGCTCCAAGGAAGCAGC
TAGCTACCAAGGCCGCGAGAAAGTCAGCTCCGGCGACCGGAGGTGT
GAAGAAGCCTCACCGTTTCCGTCCAGGAACTGTCGCTCTCAGGGAA
ATCAGGAAGTACCAGAAGTCTACTGAGTTGTTGATAAGGAAGCTGC
CATTTCAGAGGCTGGTGAGGGAGATAGCTCAGGATTTCAAGACAGA
TCTGAGGTTCCAGAGCAGTGCTGTTGCTGCTCTTCAAGAGGCAGCT
GAAGCTTACCTAGTTGGACTCTTTGAAGACACCAATCTCTGTGCCA
TTCACGCGAAGAGGGTCACCATAATGCCTAAGGACATTCAGTTGGC
CAGGAGGATTCGTGGAGAAGGGCTTAGGACGATAATTTCTTATGG
TTATGGTTATGGTTAATGTCCTGTTCTCTGTATTAGAGTTTTGTTT
GCATCTTTTGTTAAATGTCAGGGTTAGTGATGTAAATAAAATGGCT
GGTTTTGATCAAAGTACATGTAACACCTCTGGTTTACTAGTATTTG
ATTAATGAAATCTGTAGTTCATTTTGTTTcAAAAAAA SEQ ID NO:464 27819          1109831_301525_1
GCTTCCGTGCCTTTCTCTTCCTCCGCTTCAGGTAAGAGATTGAGGA
TGGCCCGTACTAAGCAGACTGCTCGCAAATCTACTGGAGGCAAGGC
TCCAAGGAAGCAATTAGCAACCAAGGCTGCTAGGAAATCTGCACCT FIGURE 9kk

```
ACCACTGGAGGGGTGAAGAAGCCACACAGATACAAGCCAGGAACTG
TTGCACTCCGTGAGATTCGAAAGTATCAAAAGAGCACTGAGCTCCT
TATTAGGAAACTGCCCTTCCAAAGGTTGGTCCGTGAGATTGCCCAG
GATTTCAAGACGGACTTGCGTTTCCAGAGCCACGCTGTGCTTGCAC
TTCAGGAGGCAGCTGAGGCTTACCTTGTGGGCTTATTTGAGGACAC
CAACTTGTGTGCTATTCATGCCAAGAGAGTCACCATCATGCCTAAG
GATATCCAACTTGCCAGGAGGATCCGTGGGGAAAGGGCTTAGCAAC
TTTTCCTTAAAAATTTGGACAACTGCACCAATGGTTTTAATAACAA
TAAGATATCTATTGACATAGATCCCCCACTATCTATTGGTCTTTT
GAACTTGGATTTTAGTTCAAATATTGCATTGAAAACATTGTGtTTA
TGCCTACTATGTgttgctcTcaataTaGtTTTGAgaatATgGACCC
TTtGaagTaaTAattt
```

SEQ ID NO:465  27819       1119041_301893_1
```
GTTCTTCTCTTCTTCCCGCCCTTTCGTATTTCTCAGTCTGGTTCAA
AGATGGCTCGTACTAAGCAGACCGCCCGTAAATCCACCGGAGGGAA
GGCCCCTAGGAAGCAGCTTGCCACAAAGGCTGCAAGGAAGTCTGCC
CCTACCACAGGTGGAGTTAAGAAGCCTCACCGATACAGGCCTGGAA
CTGTTGCTCTGCGTGAGATCCGTAAGTACCAGAAGAGTACTGAGCT
TTTGATAAGGAAGTTGCCATTTCAGAGGCTTGTTCGGGAGATTGCA
CAGGATTTCAAGACTGATCTAAGGTTTCAGAGCCATGCTGTCTTGG
CTCTGCAAGAGGCTGCTGAGGCCTACCTTGTTGGCCTGTTTGAGGA
TACCAATCTCTGTGCTATCCATGCCAAGAGGGTTACAATTATGCCC
AAGGACATCCAACTTGCGAGGAGGATCCGAGGGGAGAGGGCTTGAT
TTCTTCTTTTGCTCCTCTTTAAACTAATATGACCTTCATTCGAACA
CTTCTTTTGTTTTGAATCTGAAAGCTCTAGCAATAGACGCTAATTG
CACCCTTTTAACAATGTATTGCTTCAAATGCCTATAATagaccTAT
gttgcccTTTTGTgttcTGTaa
```

SEQ ID NO:466  30087       103526_300363_1
```
TGGTATCAACGCAGAGTGACCATACAAGCTTGATTTCCACCAAGCA
GTTGCGCTCCGCGTCTCAGCTGACAAGACAGTTTTCTACAACTGTA
ACATGGATGGATACCAAGACACACTCTACACACATTCCTACAGACA
ATTCTACAAGGACTGTACTATAACAGGCACCATTGACTTCATCTTT
GGTGATGCATCGGCCGTGTTCCAGAACTGCAAAATGATTGTCAGAA
AACCAGGTGAAAATCAAGCTTGTATGGTCACTGCTCAAGGAAGAAA
AGATCATCGCGGAGTTGGTGCAATCGTATTACAAAACTGCGATATC
ACAGCTGAGCCAGCTTTTACTAGCGCGCAGCCACCAATTAAAGCTT
ATCTTGGACGTCCGTGGAAAGAATATTCAAGAACTATTATTATGCA
GTCTTATATCGACGCATTTATTGATCCTGAAGGCTGGGCTCCATGG
AATGGAGATTTTGCTCTTAATACTTTGTTTTATGCAGAGTATCAGA
ATAGAGGAGCAGGAGCAAATATTGATAAAAGAGTTAAATGGGGTGG
TTATAAAAGAAACATTTCACCACAAGAAGCTGAGAAATATGCTCCT
GCTCATTTTATTGACCAAGATAACTGGATTAAG
```

SEQ ID NO:467  30087       110854_300047_1
```
CGGACGCGTGGGCACGCTGTAGTCTATCGATGCAATATCATGGGAT
ACCAAGATACTCTCTACGTACACTCTCAGCGCCAATTCTATCGCGA
GTGTGCTATCTATGGTACGGTTGATTTCATCTTCGGTAATGCAGCA
GTAGTCCTTCAAAACTGCAGCATTTACGCTCGAAAGCCCATGGATT
TCCAAAAGAACACCATCACTGCCCAAAACAGGAAGGATCCTAATCA
AAACACTGGCATTTCAATCCATGCTTGCAAAATCGCAGCCACATCT
GACCTCGAGGCGTCCAAAGGAAGCTTCCCCACTTATCTTGGTCGAC
CGTGGAAGTTGTACTCTCGAACCGTTGTCATGTTATCTAACTTGGG
```

FIGURE 911

TGATCATATACACCCGCGTGGTTGGTTAGAGTGGAATGCTACATTC
GCACTTGAGACATTGTATTATGGCGAGTATATGAATTATGGACCGG
GAGCAGCGGTAGGGCAACGGGTGACTTGGCCAGGATATCGGGTGAT
CACGTCAGTGGAAGAGGCAAGCAAGTTCACCGTTGCACAATTCATT
TTCGGATCGTCGTGGTTGCCTTCAACTGGGGTGGCTTTCTTGGCAG
GGTTGAATACCTGAAATTAATTGTATAATGAACATACTCCGAC

SEQ ID NO:468 30087       254583_301633_1
ACGCGTCGCATTTAGCAGCCAAGAAAGAGTTGCGAATTTGTTTTGA
GTTAGAAGATGAAAGGGGTAGGTAGGGAGACAGTTCTTGGGTAGTT
ATAGTATTAGTATACCTGGGAAATGCTAAGTCATGGGGACGAACTT
TGCTGGGTAATGAAGAAATAATGAGGCTGAGAGGGAGAGAGATTT
TACAGAGTGGGTTGAAAGGGTGGCTTCTCGAATCCGAGAACAGAGC
TTGAATACAAGCCAAGTAATGGAGAGTGTGAGTGAGAGCAAGGTGG
GTGCTCTTGTTATTACAGTTGACAAAGCTGCAGGCCAGTACAAGTC
CGTGCAGGATGCTGTCGATGCCGTGCCCTCTAATAACAATCAGCGA
GTCATCATACGAATAGCTGCTGGAATCTACCAGGAAAAGGTCGATG
TTCCTAAGAAGAAAGCATTTATAACATTTGAAGGGGCAGGAGCTGG
TTCTACCATAATCACATGGCATGACACAGCTAGCAGTGCTGGAAGC
ACGCATGACAGTGCCAGTGTGGCCATCAACTCTGACTATTTCATAG
CTAGAGGAATCACCTTCAAGAACTCCGCACCACCTCCTCCAGGTGG
AGCCGTAAATAAGCAAGCTGTTGCATTAAGAATCTCAGGCGACAAG
GCTTCCTTTTTCAATTGCAAATTCTTAGGCGCCCAAGATACTCTAT
ACGACCACAAGGGTAGGC

SEQ ID NO:469 30087       254031_301631_1
GAGGATTTCAAGGCATGGGTAGAGAGAATGGGGAGAGAGTTCGAAC
TCAAAGCAATGGGAATAGCCTGAAAAGGAAGAATCCCAAGCCCTC
CCCATAATGCAAAACGGTTCAAATCCGTTACCAGAGAGTGTGATTC
GTGTGAGTAAAGCGGGGAGTGGGCACACCTCTGTGCAGTCAGCCAT
TAATTCTGTTCCCTCGGGTAACTCTAAGAGAGTTGTGATCCATATT
GATGCTGGAGTTTATGAGGAGAAAGTGAGAATCCCTGGGAATAAGG
ACTTTATCACTTTGGAAGGAGATGGGGCTGGATCTACCATTATTAC
CGGGAGTGAAACAGCAGCAACAGCAGGAAGCTTAGCAAATAGTGCA
ATTGTAGGCGTTGACGCTGATTACTTTATTGCAAAGGGTATAACAT
TTAAGAATACCGCACCTTCACCGGAGGGAACTAACAACAGGCAAGG
AGTGGCATTAAGGATATCAGGTGATAAGGCAGCATTCTATAGTTGC
AGTTTCATTGGTACACAAGACACTCTTTATGATGACAACGGAAGAC
ATTACTTTGAGAATTGCTACATTGAGGGAGCCTCGGATTTCATTTG
TGGAGATGGCCAGTCATTATATAAGGGATGCACATTGCATGGAACC
AAATCAGGTGCATTCACTGCACAAAGACGCAGTAGTGCTGGTGGAG
ACA

SEQ ID NO:470 30087       247709_301576_1
GGGACGTTCAAGCTGACATTGCAGTTTACGGAGGACTACCCCAACA
AACCTCCCACTGTGAGATTTGTTTCAAAGATGTTCCATCCCAATAT
TTATGCTGACGGAAGTATTTGCCTCGACATCCTGCAAAATCAATGG
AGTCCAATCTACGATGTCGCGGCCATTCTTACTTCCATACAGTCAT
TGCTTTGTGATCCTAACCCGAACTCGCCGGCCAACTCCGAGGCAGC
TCGGATGTACAGCGAAAACCGCCGAGAGTACAACAGGAGAGTTCGC
GACATAGTCGAGCAGAGTTGGACGGCGGAGTAGCTCCCCTTGGTTC
AAGAGCTTGTAAGAGTGGCCATCACAGAGAGATGTGTGCTGCTCCG
AGCACACATAAAGAATCTTGTCAAAAAACAATCCGGAAAGCTGTCG
CCTCTACAGACCAGCGTTGAAGGTCGACCATCGAACTCGTTTGCTT
CTGTTGGAACCAGGGCCAGTGTTCTGGTACTCACCATAGAACAGGG

FIGURE 9mm

TGCTGAGAGCGAAGTCCCCGTTCCATTCCAACCATCCACGGGGTTG
AATTATGTCACTGATGAACGACTTCATGAACACCGTCCGCGAGTAG
AGCTTCCACGGCCTTCCGAGTTTATGAAAGACAGCCCCGTGTTCTG
TCGCTTATCGACG

SEQ ID NO:471 30087    239660_301306_1
ATCGACAGTAGTTCGAGTAGCGCAGGATGGATCGGGGCAGTATTCG
TGCGTCCAGGACGCGATCGATGCGGTGCCGCTGTGTAACAGGCAGC
GCATTGTCATCCAGGTAGCGCCCGGGTTCTATCGCCAGCCGGTCTA
TGTCCCCAAGTCCAAGAATCTGATCACTCTGCTCGGCAGCTGCGCC
GAATCGACCATTCTAAGCTGGGGGAATTGCGCCACTTCCATCGATC
ATCACAAGGCATCACAAGTGATTGGGACTGGAACATTTGGTTGCGG
GACCGTGATCGTGGAAGGCGAGGATTTCATTGCACAAGGCATTACG
TTTGAGAACTCTTCACCCAAGGGCTCTGGCCAGGCCGTGGCGATAC
GCGTCACAGCTGACAGATGTGCTTTCTACAGTTGCCGCTTCCTTGG
CTGGCAGGACACGGCCTATCTCCACTATGGACGCCAGTACTTTCGG
GACTGCTACATTGAAGGAAGCGTCGACTTTATCTTTGGAAACGCGA
CGGTGCTGCTGGAACACTGCCACATCCACTGCAAGTCCAGCGGCTA
TATCACCGCACAGCAGCG

SEQ ID NO:472 30087    156007_301362_1
AATACTAATGCACAGCTGCTGATGCTCAATCATGGTTAAGTACAGC
CTTAACCAACCTCGAAACGTGCAGAGCTGGTTTCGAAGAACTTGGG
GTCACAGATTATGTGATGCCGTTGATGTCAAATAATGTTTCATCTT
TAATTAGTAACACTTTGTCTTTGAACCATGGTTACTATACTGAGCC
AACTGCAACTCAAGTAGATGGTTTTCCAACTTGGGTTGCACCTGGT
GATCGGAAACTATTGCAATCATCTTCTCCAGCTTCTCAGGCGAATA
TTGTGGTGGCCAAAGATGGTTCAGGGAATTTCAAGACTGTGAAAGA
AGCTGTTGCTGCTGCGGGAAAGAGGAAGGGAAGTGGAAGATTTGTG
ATATATGTGAAGGCAGGAATTTACAGTGAAAATGTGGAGTTAGGAT
CAAAGTTGAAGAATATAATGTTAGTTGGAGATGGAATTGGGAAGAC
AATTATCACAGGGAGCAAGAGTGTTGGAGGAGGATCCACCACCTTC
AAATCAGCCACTGTTGCCGTTGTCGGTGATGGATTTATTTGTCGAG
GCATAACAATTAGGAACACTGCTGGCCCCAGAACCACCAAGCAGT
AGCTCTACGATCTGGCTCAGACCTTTCAGTATTCTATCAATGTAGT
TTTGAGGGATACCAAG

SEQ ID NO:473 30087    12614_300273_1
CCCACGCGTCCGACAGGCAACTTCACAAAGATAATGGACGCCATAA
AGAAAGCTCCTGATTATAGCTCGACACGTTTCGTCATATACATTAA
AAAAGGTTTATATTTGGAGAATGTTGAGATCAAGAAGAAGAAATGG
AACATTGTAATGTTAGGTGATGGCATTGACGTGACTGTTATTTCCG
GTAACCGCAGCTTCATCGATGGTTGGACCACTTTCCGATCAGCTAC
ATTCGCGGTAAGCGGAAGAGGATTCTTAGCAAGAGATATAACGTTC
CAGAACACAGCAGGGCCAGAGAAGCATCAGGCGGTAGCACTGAGAT
CAGACTCTGACCTCTCTGTGTTCTACAGATGTGCGATGAGGGGTTA
TC

SEQ ID NO:474 30087    125540_300632_1
GGGGATTCATTGCACGGGACATGACATTCGAGAACACGGCAGGACC
CCAAAAGCAGCAAGCCGTTGCATTTCGCTCCGACTCAGACTTGTCT
GTGTTGTTCAGATGCGCGTTGAGAGGCTACCAGGACACTCTCTACG
CCCATTCTATGCGCCAATTCTACCGAAACTGTATAATTACTGGCAC
GGTAGACTTCATATTTGGAGACGGCACGGTTGTCTTCCAAAATTGT
CAGATATTAGCCCGAAAGGGACTACCCGAACAAAAGAACACCATCA

FIGURE 9nn

```
CAGCTCAAGGCCGAAAAGAAGCTGCTGAAACAACAGGCTTCTCCAT
CCAATTCTCTAATATATCTGGCGAACCAGATCTATTAGCTTCACTT
AACTCTACACAAACATTCCTAGGTAGACCGTGGAAGGCCTATTCAC
GCACTGTCATCATGCAATCATACATGAGTAATGTAATTAAACCACA
AGGCTGGTTAGAGTGGAACGGTAATATATCACTTGACACATTGTAC
TACGCCGAGTATCAAAATTACGGGCCCGGTGCGGGCTTAGGCGCTA
GAGTCAATTGGCCTGGTTATCATCTACTCAATGATTCATCGCAGGC
AAATAATTTCACAGTGGCTCAATTCA
```

SEQ ID NO:475  30087        117910_300062_1
```
CCCACGCGTCCGGGAAGTTATTGGAGAGTCCAGCAGAGGACATTAA
AGCTAATGCAGTGGTAGCACAAGATGGATCAGGGGATTATCAAACA
CTTACTGAAGCAGTTGCTGCAGCACCAGATAAGAGCAAGACACGGT
ATGTGATCTATGTCAAGAAGGGAATTTACAAAGAGAATGTGGAGGT
GACTAAGAAGAAAATGAACTTGATGATTGTTGGCGATGGCATGAAT
TCTACCATTATCACTGGTAGCCTTAATGTTGTGGATGGATCAACCA
CCTTCCGCTCTGCCACTCTTGCTGCAGTTGGCCAAGGATTTATACT
ACAAGACATCTGTATACAAAATACAGCAGGACCAGAGAAACACCAA
GCAGTGGCACTTCGAGTGGGAGCTGATTTGTCTGTCATAAATCGGT
GTCGTATTGATGCTTATCAAGATACCCTTTACGCACATTCTCTAAG
GCAATTCTATAGAGACAGCTACGTAACAGGTACCGTCGACTTCATA
TTTGGTAATGCAGCCGTTGTACTCCAGAAATGCCAACTAGTACCTA
GAAAACCTGGTAAAAACCAGAACAACATGGTGACTGCACAAGGCCG
TACAGATCCAAATCAGGCCACTGGAACTTCCATTCAATTATGTGAC
ATAATAGCTAGTC
```

SEQ ID NO:476  30087        38928_300200_1
```
CCCACGCGTCCGCTTCTTCAGGGTTCAGGTGTGAAAGCTGACGCCA
CCGTGGCAGCTGACGGTAGCGGTACATTTAAAACTGTGGCTGCTGC
GGTTGCCGCGGCCCCTGAAAATAGTAATAAGAGGTATGTGATACAT
ATAAAAGCCGGAGTTTACAGAGAGAATGTGGAGGTTGCTAAGAAGA
AAAAGAATATAATGTTTATGGGAGATGGTCGGACGAGAACTATTAT
CACCGGAAGTCGAAACGTTGTATaCGGatcACCACTTtacacTCC
GccaccGttgctgcTGTcggcaacaGATTCtTatctcGGGACATCA
ctttTCcaaAacacggtgggTCCGtctaaGCACca
```

SEQ ID NO:477  30087        3020_300344_1
```
CCCACGCGTCCGACGTTTGAGAATTACGCCGGACCGGCTAAGCATC
AGGCCGTGGCACTCCGTGTTGGTGGAGACCACGCGGTGGTTTACCG
TTGCAACATTATCGGTTACCAAGACGCGCTTTACGTACATTCTAAC
CGACAGTTTTTCCGCGAATGCGAAATTTATGGAACGGTCGATTTTA
TATTCGGGAATGCGGCTGTGATCTTACAGAGTTGTAACATTTATGC
GCGTAAACCAATGGCTCAGCAGAAGATTACTATTACGGCTCAGAAC
CGAAAAGATCCGAATCAGAATACGGGGATTTCGATTCATGCTTGTA
AGCTACTAGCAACACCGGATCTTGAAGCCTCTAAGGGTAGTTATCC
GACGTATCTCGGCCGTCCGTGGAAGTTGTATTCTAGAGTTGTGTAC
ATGATGTCGGATATGGGTGACCATATTGAC
```

SEQ ID NO:478  30087        284962_200102_1
```
CCGTATTCCAAAACTGCAAATTAATAGTAAGGAAGCCAGGGGAACA
CCAGAGCTGCATGGTAACTGCTCAAGGAAGGACCACACCTGAATCG
AAAGGTGCATTCGTTATACAAAATTGTGAGATCAAAGCAGAACCAG
AGTTACTAGCAGCAAATCCACCAGTGCCGGCGTTTCTTGGACGTCC
ATGGAAGGAATATTCACGAACAATTATCATGCAATCGTTTATCGAC
GGATTCATTGATCCAGTAGGATGGGCTCCATGGAATACAACTGACT
```

FIGURE 900

TTGGACTACATACTTGTTGGTACGCTGAGTATCAGAATAGAGGTCC
AGGAGCTAGCCTTGACAAAAGGGTTAGTCATTGGAGAGGTTACCAG
AGGGTAATTTCAGGAGATGTTGCAAATTCATTTACTGCTGGTGTTT
TTATTAATCCCACAGATACTTCCTTCCTTCCTAAGGCTGATATTCC
CTATGAGGCTGGCATGATGAACGTGTAAACTTTTTTGATGTAACCT
TCAAAAATATTACAACTACTTCATTATGTTTTT

SEQ ID NO:479 30087   284265_200096_1
tgaaaacttcttgaagcaaattaccacattggtcATGACAATTATC
CTACGTGGTTTCCTGTTTCTGATCGTAAGCTTTTGGCTAACACCCC
GACTCCTCATGCAATAGTTGCAAAAGATGGAAGTGGAAAATTTAAA
ACAGTTTCTGATGC*TCTTAAAGCATACCCTCAAAACCATCAAGGC
AAATACATAGTATATGTCAAGGCTGGTGTTTACAACGAACAAGTCC
TTGTCGATAAGACACAACCGAACGTGTTTATCTTTGGAGATGGCGC
GGGGAAAACAATCATAACTTCAGACAATAATGTTGGAATCATGAAA
TTCACTACCATGAATTCTGCAACATTCGGTGTTAATGCACCAGGGT
TTGTTGCCAAAGGAATTACATTCCGAAACACAGCTGGTCCAAAAGG
ACAACAAGCCGTGGCACTCAGAATACAAGGTGATCAATCTGCAGTT
TTCGACTGCAACATTGAAGGCTACCAAGACACCTTATACTATCAAA
CCCAACGTCAATTCTATCgCAATTGTGTCATAtCAGGCACGATTGA
TTTCATCTTTGGTAGAGGCACGGCTGTAATCCAAGaTTCAACCatg
aTtTTGAGAaAACcaggagaCGACCaaataTgGAACACaaTCACAG
ccgACggtagagaggtgcagtcacaaccaacAggagttgCATtACa
aAATtGc

SEQ ID NO:480 30087   282183_200072_1
GGAAAATGTCAGTCGGAGCTATGTGGTTTATTGCAGTTATAGCCAT
TTTGCCACTCCTTTTATGTGGTGAAGGCCAGCAAGTGAAAACACCT
CACGCAATTGTTGCTAAAGATGGCTCCGGGAATTACACCACAATAA
CTGATGCCATAATTTCAGCACCAAACAATAGTGTAAATAAATACTA
CATCAAAATTAAGCAAGGGACATATTATGAATATATTCAACTAGAT
AAATGGAAAACAAACATAGTCCTAATCGGTGAAGGCATGGACAATA
CGATAATTTCAGGAAATAAGAGTTACGGTGGTGATGACATCAAAAC
CAGCCTCACCGCTACTGTGGGCGTCAATGGGAAGGGCTTTATGGCC
CAAGATATCACATTTAGGAATAATGCTGGACGAGAGAACCAACAAG
CAGTAGCATTAAGAGCAGAAGCTGACTTTCTCACTTTTTATAGGTG
TCGTTTCGATGGCTTTCAAGACACCTTATACACAAAAAAGGGAGTA
CAATTTTACAGGGATTGTGAAATACTTGGAACCATAGATTTCATCT
GTGGTGATGCAACATCCGTATTCCAGAACTGCTTAATTGAAGCACG
TCTGCCACTGCCCAAGCAATATAATACAATTACAGCACAACAAAGA
AAATTTTTGAACGACACAACAGGAATAGTGCTGCAAAATTGCACAC
TAAAAGCAACTC

SEQ ID NO:481 30087   274766_200059_1
AAGACCATAATTACTGGTAATAAGTCCGTCAAGGGACCTGGCATTG
GTTCAACTTGGCATACTTGCACTGTTGGTGTGAGTGGAGAAGGTTT
CGTGGCTAGGGATATAGGATTCGAGAACACAGCAGGACCAGCACTA
GAACAAGCAGTTGCACTACGAGTGAATGCTGACAAGGCAGTTATCT
ACAACTGCAAAATCGATGCTTATCAAGACACACTATACGCACACTC
TGGTAGACAGTTTTATCGCGATTGTATCATTTCAGGAACCATAGAT
TTACTGTTTGGTGATGC

FIGURE 9pp

SEQ ID NO:482  30087      255679_301644_1
GCACACCTCTGTTCAGGCTGCCATTAACTCTGTGTCCTCTGGTAAC
TCTAAAAGAGTTGTCATCCATATTGCTGCCGGAGTTTATGATGAGA
AAGTGAGAATCCNCTGGGAATAAGCACTTTATCACTTTGGAACGGA
GATGGGGCTGGATCCACCATTATTACTGGGCATTCAACAGAAGCGA
CTGCAGGAAGCCTAGCAAATAGCGCAACCGTGGCCGTTGACTCTGA
TTATTTCATTGCAAGGGGTATAACATTTAAGAATTCAGCGCCTTCA
CCAAAGGGATATAACAACAGGCAAGGAGTGGCATTAAAGATATCTG
GTGATAAAGCATCATTCTATAATTGCAATTTCATTGGTACACAAGA
TACTCTTTATGATGACAAAGGAAGGCATTACTTTGAGAACTGCTAC
ATTGAGGGAGCATCGGACTTCATTTGCGGAGACGGCCAATCATTAT
ATAAGGGGTGCACACTACATGGAACCTCATCTGGCGCGTTCACTGC
ACAAAGACGTAGTAGTGGTGGTGGAGAAACTGGCTACTCATTTGTA
GGTTGTAAACTAACTGGTT

SEQ ID NO:483  30087      107565_300379_1
cttttggctaacaccccaactcctcatgcaatagttgcaaaagatg
aaagtggaaaatttaaaactgttttgatgctctTAAAGCATACCC
TCAAAACATCAAGGAAAATACATAATATATGTCAAGGCGGGTGTT
TATAACGAACAAGTCCTTGTCGATAAGAAACAACCAAACGTGTTTA
TCTATGGAGATGGCGCGGGGAAAACAATCATAACTTCAGACAAAAA
TGTCGCAATCTTGAAATTCAGCACCATGAATTCTGCTACATTTGGT
GTTAATGCACCAGGATTTGTTGCCAAAGGAATTACATTCCGAAACA
CAGCTGGTCCAAAAGGACAACAAGCCGTGGCACTCAGAATACAAGG
TGACCAATCTGCAGTTTTCGACTGCAACATTGAAGGCTATCAAGAC
ACCTTATACTATCAAAGCAAACGTCAATTCTATCGCAATTGTGTCA
TATCAGGCACGATCGATTTTATTTTTGGCAGGGGCACAGCTGTAAT
CCAAGATTCCACCATCATTTTGAGAAAACCAGGGGATGACCAAAAA
TGGAACACAATCACAGCAGATGGTAGAGAAGTGCAGTCACAATTAA
CAGGAGTAGCGTTACAAAATTGCAAAATCGTCGCAGAAAAGGAACT
CATCGATACTAAAATCGTCCAGAATTTCTTGGGACGTCCATGGAAG
GCGTTATCGACCAATGTTGTAATGGAGAGTGAAATTGGTGGTTTTA
TTAATCCagaaggATGGAAGATATGGGATAACGAACATTACGAGCA
AACATGTGAATGTTATGAATATGCTAATAGaggACCTgGgcgCTGc
tacTaaTggac

SEQ ID NO:484  30087      9776_300303_1
CCCACGCGTCCGAACATCTTCATGTTCGGAGATGGTGCAAGAAAGA
CCGTCATTTCTTACAACAGAAGTGTTAAACTCAGCCCTGGAACCAC
CACTTCCCTTAGTGGCACAGTCCAGGTTGAGTCCGAAGGATTCATG
GCAAAATGGATCGGATTCAAGAACACCGCCGGTCCAATGGGACACC
AAGCTGTGGCTATCAGAGTGAACGGAGACCGTGCCGTGATCTTCAA
CTGCAGGTTCGACGGTTACCAAGACACCTTGTACGTCAACAATGGT
CGTCAGTTCTACAGAAACATTGTCGTGTCAGGAACAGTCGACTTCA
TCTTCGGCAAATCCGCAACCGTGATCCAAAACTCACTCATTGTTGT
CCGTAAAGGAAACAAGGGACAATTCAACACGGTCACAGCCGATGGA
AACGA

SEQ ID NO:485  30087      39346_300495_1
tttacatctcgattctaatactacgatgatctagagaaagtacaca
ccccatacaaaacaaagaggacatcacgatttgcttcatACactAT
TAATcaataAtTtTTgtagcCAACACTACGTAggaaCACATTACAC
AACaAtctctCAAAGACCGagcGaAAAGGGGAAACCGgacGACGAT
AACCAgcCtCcCACCACCAATAAACTGACCAgcCGTATATTTTTGAG
CTTCagCAGCAGCCGTAATTACCTTAAAGCCCCTccACTTCACTCt FIGURE 9qq AttTgcagctccAGCCCCTGCTCctgtgTtcgaATACTCTCTGTAA
GTCAGAGTGttCAACGCAAAAGTCCCGGTCCACTCGGACCACCCTT
CGGGTCGGATCAcgtcggagaTAgccgActgcAtTatcacCGTttG
TGAATAttccTTCCATGGccgACCCAAGTACGTCGGAAAACtACCT
TTCACCGACTGTAAATCCGACGTGGcaCCGATCCTACATTTCTGGA
TAACGATCCTGTGTTCTGGTTAGGATCCGTTCTTCcctGAGCTGT
GACCATGTTTTCTGACCGGAATTAGGGCGGCGAGCGTGGATGTCA
CAGTCTTGGAGCACGACGGCGGCGTTTCCGAAGATGAAGTCAacGG
TTCCGGCGATGAGACATTTGACGAAGAATTGACGGTTAGAGTGGAC
GTATAGAGTGTCTTGATAAGCTAACATGTCGCAATTGTAGAAGGCG
GAGAAAT

SEQ ID NO:486 30913     267868_200119_1
GCTGCAGATATCAAAAAGGATCTTCACCTA*GATCCTTTTAAATTA
AAAATGAAGTTTTAGCACGTGTCAGTCCTGCTCCTCGGCCACGAAG
TGCACGCAGTTGCCGGCCGGGTCGCGCAGGGCGAACTCCCGCCCCC
ACGGCTGCTCGCCGATCTCGGTCATGGCCGGCCCGGAGGCGTCCCG
GAAGTTCGTGGACACGACCTCCGACCACTCGGCGTACAGCTCGTCC
AGGCCGCGCACCCACACCCAGGCCAGGGTGTTGTCCGGCACCACCT
GGTCCTGGACCGCGCTGATGAACAGGGTCACGTCGTCCCGGACCAC
ACCGGCGAAGTCGTCCTCCACGAAGTCCCGGGAGAACCCGAGCCGG
TCGGTCCAGAACTCGACCGCTCCGGCGACGTCGCGCGCGGTGAGCA
CCGGAACGGCACTGGTCAACTTGGCCATGGTGGCCCTCCTCACGTG
CTATTATTGAAGCATTTATCAGGGTTATTGTCTCATGAGCGGATAC
ATATTTGAATGTATTTAGAAAAATAAACA*AATA*GGGGTTCCGCG
CACATTTCCCCGAAAAGTGCCACCTGATGCGGTGTGAAATACCGCA
CAGATGCGTAAGGAGAAAATACCGCATCAGGCGAAATTGTAAAGAT
ATCGCGGCCGCTTAATTAATGACAAGAACACGAACTGAGAt

SEQ ID NO:487 34136     154925_200017_1
catcaccgtctgcgccattgacaatgccgccatgaacgaactcctc
gaaaaacacctccctacttacacactcaaaaacgTCCTTTCCCTTC
ACGTATTCGCCGATTACTTCGGCGCCAAGAAACTTCACCAACTTAC
AAAAGGCAgttcttctttccgCCACCATGTTCCAAGCCACTGGTGA
AGCTCCGGGAACCTCCGGTTACATCAACATCACCAACATGAAAGGC
GGCAAAGTAGGTTTCGCAAATGAAGATAACGACGGCCATTTCACCG
CTACGTTCGTTAAAACCGTACTAGAAATGCCTTACAACATTTCAGT
TATTCAAATTAGCCATGTTTTAACTTCAGCCGCCGCCGAAGCTCCT
GTTGCAGCGCCCAGTGACTTAAACATCACAACCCTAATGTCCGAAC
AAGGATGCAAAGCCTTTTCCGATTTACTAAAATCCCATCCAGATGT
TTCAAAAACATTTGCAGAAAATGTAGAAAGTGGATTAACAGTGTTt
tgTCCTACAGATGGAGTTTTAAACGGTTTCATGCCGAAATTCAAGA
AGTTGACTAAAGATgGTCAAGCTTCTTtattattatACCACggtat
tcccGTTtacaattctttaggtatgttgaaATCCaaccaatgggtt
aaTGAacactttagctaCTGagggaaaaaaTAAGTACGACTTCACT
GTACAAAATGATGgAGatgAcgttatgttaaagaccaaggttgttt
acagcgacaatatctggaacattgtaccgatGAGgaaccattgtcG
GtttataaagttgataaagttttgttgccacgggaactgtttaaAG
CAgtagcagaagaaccagcaCCTGCGCCAAAGGGTTcgaAgaagAA
GAAGAgtaaaaaggtggCGGTGACGATGTAGAGGACGACAGTGCG
CcggagcctagtctggAGGAAGACGATGCTCCGGCGGATGAGTCGG
AAAACTTGAACGGAGCTATTagtgtgaaaagtagtGGGtggttggt
tACAGT FIGURE 9rr SEQ ID NO:488  34136       6474_300322_1
CCCACGCGTCCGGAAGAAGTTCCGTATAACATCTCCATTATTCAGA
TCAGTAGAGTTTTACCGTCGGAGACTGCGGCGGCTCCGACTCCTGC
TCCGGCGGAGATGAATCTTACCGGAATAATGTCGGCTCATGGATGC
AAAGTGTTTGCTGAGACTCTTCTCACTAACCCTGGAGCTTCAAAAA
CCTATCAGGAGAGTTTAGAAGGAGGCATGACAGTGTTCTGTCCAGG
AGATGATGCAATGAAAGGTTTCTTGCCCAAATACAAGAACTTGACA
GCTCCAAAGAAGAAGCATTTCTCGATTTCCTCGCTGTCCCGACAT
ATTACTCAATGgCGAtgccaaatccaacaatggtccgATGaaCACA
CttGCGACAGAtggagc SEQ ID NO:489  34442       146340_301065_1
aaaatcattttttgcccagggatgatcgcttcatggttatcaaggaa
gacatggaaagaactttgaagaacactaacatgaAACCATTGAATC
ATTCATCATACCTGCGATTGCAAGTCTTGTGTCAGAGCTTCTGGAA
CGTGGAAGAGAAGTTGCTCTTGTTAAATGACTTGACTCTCGCTGAG
CTGAAAGCTTTCATTCCAGAGCTTCTTTCCCAGCTGTATATTGAGGG
CCTTTGTCATGGAAATTTGCTGGAGGAAGAAGCACTAAACATATCAA
ACATTTTTAGAAGTAATTTCTCTGCACAACCGCTACCATCTGAGATG
ACGCATAAAGAGTATGTCATGTGTCTTCCAGCCACCGCTGACCTAGT
CAGAGATATCAGAGTAAAAAATAAACTGGAAACAAACTCTGTGGTTG
AGCTGTATTTTCAGATTGAACCTGAAgaagACACTTCCTTGATAAAA
TTAAAAGCAGTAACAGATCTCTTTGATGAACTCGTGGAGGAGCCACT
TTTTAATCAGCTAAGGACAAAGGAGCAGCTTGGTTATGTTGTTGACT
GTAGTGCACGTGTAACATATCGCATAATGGGGTTCTGTTTCCGTGTT
CAGTCATCTGACTATGATCCTGTCTACTTAGAAGGGAGGATTGACAA
CTTCATAGATAGTGTGAAAGAGTTGTTGGACGGCCTCGATGATAAAT
CTTTTGAGAGCTACAGAAGTGGGTTGATAGCAAAACTTTTGGAGAAA
GACCCATCGCTCGCATATGAAACAAATCGCCTTTGGGGTCAGATTAC
TGATAAAAGGTACATGTTTGACATGTCTGAGAAGGAAGCGGAGGAGC
TGCGGAGCATTCAAAAAAGTGATTTAGTTGAGTGGTACCATACTTAT
TTAaGACGaCcatCTcccaaGTGCCGGAGACTCTCTGttCGggTAT SEQ ID NO:490  34442       235113_301224_1
GAATCACGAAGCTAGAGACGTCCGCGATGTTTTACCCGATATCGGGT
ATGAGTCCCGACAACGACAACTCGGCTCTTCACGTCTCATCTTCAGG
TTGGACAAGACGAAACAGTCATGAACGTTCTTGTGGAACTATTTGTT
CTCAGTGCCAAACAACCAGCTTTTCATCAACTTAGAACTATTGAGCA
GCTCGGATATGTAACTGCTTTGATAAACAGAAATGATTCTGGAGTTC
AAAGCGTTCAGTTCATTATACAGTCCACTTTGAAGGATCCCAAAGCT
ATTGAAGAAAGAGTGGAAGATTTTCTCAAATCATTTGAGGCAACGCT
TGTGAACATGAGCGACGAGGAATTCCAGAGAAACTTGGAAGCTCTTG
TTGAAATCAAGCTTGAGAAACACAAAAATATTTACGAGGAGACCAAC
TTCTTCTGGAAGGAAATCGACAATGGGGTGTGCAAGTTCGACAGGAG
AGAAGTGGAGGTTGCTGCGCTTCGAAAGCTCAAGAAAGAACAGCTGC
TACAGTTTTACATGGATTACTTGAAAAGTGGTGCACCAATGCGAAGA
AAGCTGAGCATCCAGATCTATGGCAAGCTCCACAAG SEQ ID NO:491  38919       1007809_301403_1
acgcgtcgcATTTTTCGTTCTTTTTGCGTTTCTCTCTCTCTCGCT
CTCTCTTTCTGTTTCCTGTGAAAATGCAGATCTTTGTGAAGACCCTG
ACGGGGAAGACCATCACCCT*GGAGGTGGAAAGCTCCGACACCATTG
ATAACGTCAAGGCCAAGATCCAAGACAAGGAGGGCATCCCCCCTGAC
CAGCAGCGCCTCATCTTTGCCGGGAAACAGCTTGAAGATGGCCGTAC
CCTTGCAGACTACAACATCCAGAAGGAGTCCACCCTCCACCTTGTCC FIGURE 9ss TCCGCCTCCGAGGTGGTATGCAAATCTTCGTCAAAACCCTCACCGGT
AAGACCATCACCCTCGAAGTTGAGAGCTCTGACACTATCGACAATGT
CAAGGCCAAGATCCAAGACAAGGAAGGGATTCCCCCTGATCAGCAGA
GGCTTATCTTCGCTGGGAAGCAGCTCGAAGACGGGCGAACCCTCGCT
GACTACAACATCCAAAAGGAGTCCACCCTCCACCTCGTGCTGAGGCT
CCGGGGAGGCATGCAGATCTTTGTCAAAACCCTGACGGGGAAGACAA
TAACACTGGAGGTGGAAAGCTCTGACACAATTGACAACGTTAAAGCT
AAGATTCAAGACAAGGAAGGGATCCCCCCCGATCAGCAGCGTTTGAT
CTTTGccGGCAAGCAGCTGGAAGA

SEQ ID NO:492 38919       104285_300060_1
ATTCTTCTCTCCCTTTGCGAAACAAGCTAACTTTCTCCCGAGTCTTT
TTCTTCTTCCTCTCAAGATGCAGATCTTTGTAAAGACACTCACTGGG
AAAACCATTACTCTTGAGGTTGAGAGTTCAGACACAATTGATAACGT
GAAGGCCAAAATTCAAGACAAGGAAGGGATTCCCCCAGACCAGCAGA
GGCTGATATTTGCTGGAAAGCAGCTTGAAGATGGCCGAACTCTTGCT
GATTACAATATTCAAAAGGAGTCTACCCTCCACCTTGTCCTCCGTCT
ACGTGGTGGTATGCAGATTTTTGTTAAAACTCTTACTGGCAAAACCA
TTACTCTTGAGGTCGAGAGTTCAGACACCATTGACAATGTTAAGGCC
AAGATTCAAGATAAGGAAGGCATTCCACCTGATCAGCAAAGGCTGAT
CTTTGCTGGAAAGCAACTTGAGGATGGAAGGTCCCTCGCGGATTACA
ACATTCAAAAGGAGTCGACCCTACATCTTGTCCTCCGTCTACGTGGT
GGCATGCAGATTTTTGTTAAAACTTTAACGGGCAAGACGATCACTCT
TGAAGTTGAGAGCTCAGATACCATTGACAATGTAAAGGCAAAGATCC
AGGACAAGGAGGGTATTCCTCCAGACCAGCA

SEQ ID NO:493 38919       111165_300052_1
TCATCGCCTTCAAATTTCTCTCTCAAGGTTTGAGAAAATTTCCTCAA
TTTCTCGCTTTAGGAGTTCTTTTTTATTGAATCACC*GATTTGGGTG
TGTCAAGCCCTAATTTTGAAGTTCATTTTTTCAATTGTTTGTTGTTG
ATTTTATGTTATAACAGATGCAGATCTTCGTAAAAACCCTAACCGGT
AAGACCATCACTCTCGAGGTTGAGAGTTCCGACACAATCGACAACGT
AAAAGCCAAAATCCAGGATAAGGAAGGAATTCCCCCAGATCAGCAAA
GGCTTATCTTCGCCGGCAAGCAGCTTGAGGACGGCCGTACCCTAGCC
GATTACAACAT*CCAGAAGGAATCTACCCTGCACTTGGTCCTCCGTC
TGCGTGGTGGGATGCAGATTTTCGTCAAAACCCTCACTGGCAAAACA
ATCACCCTTGAGGTGGAAAGTTCTGACACCATCGACAATGTCAAGGC
TAAAATTCAGGATAAGGA*GGGAATTCCACCAGAC*CA*GCAGAGGT
TGATCTTCGCTGGCAAGCAGCTTGAGGATGGTCGTACCCTTGCCGAT
TACAACATCCAGAAGGAGTCTACCCTTCACCTTGTCCTCCGTCTCCG
TGGTGGTATGCAGATCTTTGTCAAAACGCTCACCGGCAAAACCATCA
CCCTTGAG*GTCGAGAGTTCC*GACACCATCGACAATGTCAAGGCCA
AAATTCAGGACAAGGAGGGCATTCCCCCAGACCAGCAGAGGTTGATT
TTCGCTGGCAAGCAGCTCGAGGATGGCCGTACACTAG*CTGAT**TA
TAACATCCAGAAGGAATCCACCCTTCACCTTGTCCTCCGTCTCCGTG
GTGGTATGCAGATCTTCGTCAAAACACTCACCGGCAAGACCATCACC
CTGGAGGTTGAAAGCTCTGACACCATTGACAATGTTAAGGCCAAGAT
CCAGGACAAAGAGGGGATTCCCCCAGATCAGCAGAGGTTGATCTTCG
CAGGAAAGCAGTTGGAAGATGGTCGCACCCTTGCGGACTACAACATT
CAGAAGGAGTCTACTCTGCACTTGGTGCTAAGGCTGAGGGGAGGAAT
GCAGATCTTCGTGAAGACATTGACGGGAAGACCATCACCTTGGAGG
TGGAAAGCTCTGACACCATCGACAATGTCAAAGCTAAGATCCAGGAC
AAGGAGGGTATCCCACCGGACCAGCAGAGGTTGATCTTTGCTGGTAA
GCAGCTTGAGGATGGAAGGACCCTGGCCGACTACAATATCCAGAAAG
AGTCAACCCTTCACCTTGTCCTCCGTCTCCGTGGTGGTTTCTAGGTT

FIGURE 9tt

GCCTGTTGTTGATGTTGTTGTGTCGTGTTGATTGGCTGTGTCTTGTT
GTGGTCATGATGTGTTTTGTCTACTAAGGTCCCAAAGATGTTCAATT
CTGTTTCTGTTCGCCGTTTCTTTCATATTTTCTGTTGTGAATAAAGA
CACCAGATTCTGTCCTAGTGCTTAGGTTTTGTGCTCTCTGTTGGCAG
TaaaTGAACTTTCCTTTGTTTTatccatt

SEQ ID NO:494 38919        1113240_301796_1
GGCAGAGAGAGGAGAGGGAGAGAGAGATGCAGATCTTCGTGAAAACC
CTAACAGGGAAGACCATCACTCTCGAAGTCGAGAGCAGTGATACCAT
CGACAATGTCAAAGCCAAGATCCAGGACAAAGAAGGGATACCACCAG
ATCAGGAGAGGCTGATATTTGGTGGCAAGCAGCTTGAAGATGGGCGC
ACACTGGCTGATTACAACATCCAAAAGGAGTCCACACTGGATCTGGT
GCTGAAGTTGCGTGGAGGGACCATGATCAAGGTTAAGACCCTCAATG
GGAAGGAAATT

SEQ ID NO:495 38919        143611_200045_1
acttttctctttacttcaaacgcctctcaagagcagatcttcgtcaa
aacccttaccGGAAAGACGATAACCCTTGAGGTTGAAAGCTCCGACA
CAATTGACAACGTTAAGGCTAAGATTCAGGACAAAGAAGGAATCCCA
CCGGACCAGCAAAGGTTGATCTTCGCCGGAAAGCAGCTCGAAGACGG
CAGAACCCTAGCTGATTACAACATCCAAAAGGAATCCACCCTTCACT
TGGTGCTCCGTCTTCGTGGCGGTATGCAAATCTTTGTTAAACCCTA
ACCGGGAAAACAATAACCCTTGAAGTCGAAAGCTCTGACACAATTGA
CAATGTCAAGGCGAAGATTCAGGACAAGGAGGGAATCCCTCCAGACC
AGCAAAGGTTGATTTTTGCCGGAAAGCAACTCGAAGACGGCAGAACC
CTAGCTGATTACAACATCCAGAAGGAATCGACCCTTCACTTGGTCCT
TCGTCTTCGTGGTGGGATGCAGATCTTCGTCAAAACCTTAACTGGGA
AAACAATCACCCTTGAAGTCGAAAGCTCCGACACCATTGACAATGTC
AAGGGTAAAATCCAGGATAAGGAGGGAATCCCACCAGACCAGCAAAG
GTTGATTTTTGCTGGTAAGCAATTGGAAGATGGCCGTACCCTAGCTG
ATTACAACATTCAAAAGGAGTCGACTTTGCACCTTGTGCTCCGTCTT
CGTGGTGGGATGCAGATTTTCGTGAAGACATTGACCGGGAAAACCAT
CACTCTTGAGGTGGAAAGCTCTGACACTATTGACAACGTTAAGGCCA
AAATCCAGGATAAGGAGGGAATCCCACCAGACCAGCAGAGATTGATT
TTTGCTGGTAAGCAGCTGGAGGATGGCCGAACCCTCGCTGATTACAA
CATTCAGAAGGAGTCTACCCTTCACTTGGTTCTCCGTCTCCGCGGTG
GGATGCAGATCTTCGTCAAACACTCACTGGGAAGACAATCACCCTC
GAAGTTGAAAGCTCCGATACTATCGACAATGTTAAGGCTAAGATTCA
GGACAAGGAAGGTATTCCACCGGACCAGCAGAGATTGATTTTTGCTG
GTAAGCAGTTGGAAGATGGGAGAACTTTAGCTGATTATAATATCCAG
AAGGAATCCACACTGCATTTGGTGCTCCGTCTTCGTGGTGGGATGCA
GATTTTGTGAAGACGTTGACCGGGAAAACCATCACTTTGGAGGTAG
AGAGTTCTGATACGATCGACAATGTGAAGgctaagaTTTaggACAAG
GAGGGTATCccgccagatcagCagaggcTGATTTTTGCTGGGAAGCA
GTTGGAagatggaaggACTCTGGCTGATTATAAtAttc

SEQ ID NO:496 38919        14164_300269_1
CCCACGCGTCCGCTCAAAATCTTAAAAACTTTCTCTCAATTCTCTCT
ACCGTGATCAAGATGCAGATCTTTGTTAAGACTCTCACCGGAAAGAC
AATCACCCTCGAGGTGGAAAGCTCCGACACCATCGACAACGTTAAGG
CCAAGATCCAGGATAAGGAGGGCATTCCTCCGGATCAGCAGAGGCTT
ATTTTCGCCGGCAAGCAGCTAGAGGATGGCCGTACGTTGGCTGATTA
CAATATCCAGAAGGAATCCACCCTCCACTTGGTCCTCAGGCTCCGTG
GTGGTATGCAGATTTTCGTTAAAACCCTAACGGGAAAGACGATTACT
CTTGAggtgGAGAgttCTGACACCATCGACAACGTCAAGGCCAAGAT FIGURE 9uu

```
CCAAGACAAGGAGGGCATCCCCCCCGACCAGCAGCGCCTCATCTTCG
CTGGTAAGCAGCTCGAAGATGGCCGCACCCTCGCTGATTACAACATC
CAGAAGGAGTCTACCCTCCACCTTGTCCTTCGCCTCAGGGGTGGTAT
GCAAATCTTCGTCAAAACCCTCACTGGAAAGACCATTACTCTCGAGG
TCGAGAGCTCCGACACCATCGATAATGTCAAAGCCAAGATCCAAGAT
AAGGAGGGAATCTCTCCCGACCAGCAGCGCCTCATCTTTGCTGGCAA
GCAGCTCGAAGACGGccGCACCCTTGCTGACTACAACATCCAGAAGG
AGTCGACCCTTCACCTTGTGCtgcgGCTCCGAGGGGCATGCAGATA
TTCGTCAAAACCCTGACCGGGAAGACGATAAccTTGGAAGTGGAgag
ctCTGACACAATCgacaacGTGAAAGCGAagatccaagacaaggAAg
ggatccctcCTGATCa
```

SEQ ID NO:497 38919    139045_300406_1
```
ccccgagccaagaggggaaaaaaaagggaagaaatttttttctttt
tttttgttcgcctccgcttcttcctcacgcagCTCTCGCCTCGCCT
CGCCGCCCGCCACTAGAGAGGAGAGGGAGAAGGAGAAGGAGGCGAAT
CCCAGCAAAAGAAGATGCAGATCTTCGTGAAGACCCTGACTGGGAAG
ACCATCACCCTCGAGGTGGAGAGCAGCGACACCATCGACAATGTCAA
GGCTAAGATCCAGGACAAGGAGGGAATCCCGCCGGACCAGCAGCGGC
TGATCTTCGCCGGGAAGCAGCTGGAGGACGGACGCACCCTGGCTGAC
TACAACATCCAGAAGGAGTCCACCCTCCACCTCGTCCTCAGGCTCCG
TGGCGGTATCATCGAGCCGTCGCTTCAGGCGCTTGCCCGCAAGTACA
ACCAGGACAAGATGATCTGCCGCAAATGCTATGCGCGCCTGCACCCT
AGGGCTGTCAACTGCCGCAAGAAGAAGTGTGGTCACAGCAACCAGCT
GAGGCCCAAGAAGAAGATCAAGAACTAGAGCGTCACTCGCCGGGTTC
ATGGACTGGTTAAATCAATCGTCATATTAGACTTTTATGCTTCCGTT
GTTaTCTCCCTGGATGTTGTTGAACCGTGTTTTACTGTGCTGGATGC
TtcagCTTCTTGTTTTGACGGTCGTGGTATATGGTAAttGgcagcaa
aCTATAttggtcatgtcgaAATtGTc
```

SEQ ID NO:498 38919    138074_300688_1
```
cGAAAAATTTCTCCCCAATCTCGCGAGGCTCTCGTCGTCGAATCGAA
TCCTCTCGCGTCCTCAAGATGCAGATCTTTGTGAAGACATTGACCGG
CAAGACTATCACCCTCGAGGTGGAGTCCTCTGACACCATCGATAATG
TCAAGGCTAAGATCCAAGATAAGGAGGGCATCCCCCCGGACCAGCAG
CGTCTCATCTTCGCTGGCAAGCAGCTGGAGGATGGCAGGACCCTTGC
TGACTACAACATCCAGAAGGAGTCGACCCTTCACCTTGTCCTCCGCC
TCCGTGGTGGCATGCAGATCTTTGTCAAGACTCTGACCGGCAAGACT
ATCACCCTTGAGGTGGAGTCTTCTGACACCATCGACAACGTCAAGGC
CAAGATCCAGGACAAAGAGGGCATCCCCCCAGACCAGCAGCGTCTCA
TCTTCGCCGGCAAGCAGCTGGAGGATGGCAGGACCCTTGCTGACTAC
AACATCCAGAAGGAGTCCACCCTCCACCTTGTCCTCCGCCTCCGTGG
TGGCATGCAGATCTTTGTCAAGACACTGACCGGCAAGACCATCACCC
TCGAGGTGGAATCTTCTGACACCATCGACAACGTCAAGGCCAAGATC
CAGGACAAGGAGGGCATTCCCCCGGACCAGCAGCGTCTCATCTTTGC
CGGC*AAGCAGCTTGAGGACGGCAGGACCCTTGCTGACTACAACATC
CAGAAGGAGTCAACGCTTCACCTTGTCCTCCGTCTCAGGGGAGGCAT
GCAAATCTTCGTGAAGACTCTGACCGGCAAGACCATCACCCTCGAGG
TGGAGTCTTCTGATACCATCGACAATGTCAAGGCCAAGATCCAGGAC
AAGGAGGGCATTCCCCCGGACCAGCAGCGCCTCATCTTTGCTGGCAA
GCAGCTGGAGGATGGCAGGACCCTTGCTGACTACAACATCCAGAAGG
AGTCCACCCTCCACCTTGTGCTCCGCCTTCGTGGTGGTATGCAGATC
TTTGTCAAGACCCTCACAGGCAAGACCATCACCCTGGAGGTTGAGAG
CTCGGACACCATCGACAACGTCAAGGCCAAGATCCAGGACAAGGAGG
GCATCCCCCCAGACCAGCAGCGTCTCATCTTCGCCGGCAAGCAGCTC
```

FIGURE 9vv

GAGGATGGCCGCACCCTCGCCGACTACAACATCCAGAAGGAGTCTAC
CCTCCACCTGGTGCTTCGTCTCCGTGGTGGTATGCAGATCTTCGTGA
AGACCTTGACTGGGAAGACCATCACTTTGGAGGTTGAGAGCTCCGAC
ACCATTGATAATGTGAAGGCCAAGATCCAGGACAAGGAGGGGATTCC
CCCAGACCAGCAGCGTCTGATCTTCGCTGGCAAGCAGCTGGAGGATG
GACGCACCCTCGCCGACTACAACATCCAGAAGGAGTCCACCCTCCAC
CTGGTGCTCCGCCTCCGTGGTGGTCAGTAATCAGCCAGTTTGGTGGA
GcTgccGATGTGCCTGGTCGTCCCGAGCCTCTGTTCGTCAAGTATTT
GTGGTGCTGATGTCTACTTGTGTcTGGTTTAATGGACCATCGAGTCC
GTATGATATGTTAGTTTTATGAAACAGTTTCCTGTGGGACAGCAGTA
TGCTTTATGAATAAGTtggatTTGAACCTAaAT SEQ ID NO:499   38919      137679_300726_1
attattactcgaccacgcgtcgaAAAATCTCCCCTCGAAGCGAAGCG
TCGAATCGCCTTCTCAAGATGCAGATCTTTGTGAAGACCCTCACCGG
CAAGACCATCACCCTCGAGGTTGAGTCCTCGGACACCATTGACAATG
TCAAGGCCAAGATCCAGGACAAGGAGGGCATCCCCCCGGACCAGCAG
CGTCTCATCTTCGCTGGCAAGCAGCTTGAGGATGGCCGCACCCTGGC
CGACTACAACATCCAGAAGGAGTCCACCCTCCACCTTGTGCTCAGGC
TCAGGGGAGGCATGCAGATCTTCGTCAAGACCTTGACTGGCAAGACC
ATCACCCTTGAGGTCGAGTCGTCTGACACCATTGACAATGTCAAGGC
CAAGATCCAGGACAAGGAGGGCATCCCCCCAGACCAGCAGCGTCTCA
TCTTCGCCGGCAAGCAGCTGGAGGATGGCCGCACCCTTGCTGACTAC
AACATCCAGAAGGAGTCCACCCTCCACCTTGTGCTCAGGCTCAGGGG
AGGTATGCAGATCTTCGTCAAGACCCTGACCGGCAAGACCATCACCC
TCGAGGTCGAGTCCTCGGACACGATCGACAACGTGAAGGCCAAGATC
CAGGACAAGGAGGGCATCCCCCCGGACCAGCAGCGTCTCATCTTTGC
TGGCAAGCAGCTGGAGGATGGCCGCACCCTTGCCGACTACAACATCC
AGAAGGAGTCCACCCTCCACCTTGTGCTCAGGCTCAGGGGTGGTATG
CAGATCTTCGTCAAGACCCTGACCGGCAAGACCATCACGCTTGAGGT
CGAGTCCTCGGACACGATCGACAATGTGAAGGCCAAGATCCAGGACA
AGGAGGGTATCCCCCCGGACCAGCAGCGTCTCATCTTCGCCGGCAAG
CAGCTGGAGGATGGCCGCACCTTGGCTGACTACAACATCCAGAAGGA
GTCCACCCTTCACCTGGTTCTCAGGCTCAGGGGTGGGATGCAGATCT
TCGTGAAGACCCTGACTGGCAAGACCATTACCCTTGAGGTTGAGTCG
TCCGACACTATTGACAACGTGAAGGCGAAGATCCAGGACAAGGAGGG
CATCCCCCCGGACCAGCAGCGTCTGATCTTTGCTGGTAAGCAGCTTG
AGGATGGCCGCACCCTTGCGGATTACAACATCCAGAAGGAGTCCACA
CTCCACCTGGTGCTCCGCCTCCGTGGTGGCCAGTAAGTCCTCAGCCA
TGGAGCTGCTGCTGTTCTAGGGTTCACAAGTCTGCCTATT*GTCTTC
CCCAATGGAGCTATGGTTGTCTGGTCTGGTCCTTGGTCGTGTCCCGT
TTCATTGTGTACTATTTACCTGTAATGTGTATCCTTAAGTCTGGTTT
GATGGTGTCTGAAACGTTTTGCTGTGGTAGAGCAGCATGGAAGAACT
ATAATGAATAAGTGATCCCTAATCATTGTGTCC SEQ ID NO:500   38919      135205_300412_1
CCCAGACCAGCAAAGGCTGATTTTCGCAGGGAAGCAACTGGAAGATG
GACGTACATTAGCTGATTACAACATTCAGAAAGAGTCAACGCTCCAT
TTGGTCCTGAGGCTCAGGGGTGGAACCATGATCAAGGTGAAGACACT
CACTGGGAAGGAAATCGAGATCGACATCGAGCCCACTGATACCATTG
ATAGAATCAAGGAGCGTGTTGAGGAGAAAGAGGGTATTCCACCTGTT
CAGCAGAGGCTCATTTATGCTGGGAAGCAACTTGCTGATGATAAAAC
TGCCAAGGATTACAACATTGAAGGTGGCTCAGTGCTCCATCTCGTGC
TTGCTCTGAGGGGTGGTCAGTAGATGTAGTTTCCATGCCCGCATTAT
CTCTAAAGGGAGAAGCATATTTGCTATTCCATTTCTATCTGTAGTTG FIGURE 9ww CTGCAGACTTATAGCTATATTTGGTAGGATTATTGAAGTACTATGCG
ATTGGCGCATTGTGTATTGGAATCAATTGTCATCTGTACTGGAAAGG
AAATATTGGAACTAAGTTAAGCAGTAGTTTATCAATTGCC

SEQ ID NO:501 38919    127229_300469_1
cccccccccgagtatcattccattctcaagagggaagaAATTCTAGC
GCCGTAGTGCTCCTCGAGTTCTCTCCTCCAAAGCGAAGATGCAGATC
TTCGTGAAAACCCTAACGGGTAAAACAATCACCCTTGAGGTTGAATC
TTCCGACACAATCGATAATGTGAAAGCCAAGATCCAAGATAAGGAAG
GGATTCCCCCAGATCAGCAGCGTCTGATTTTCGCCGGAAAGCAGCTT
GAAGACGGCCGAACCCTAGCCGATTACAACATCCAGAAGGAGTCGAC
TCTTCATCTCGTGCTCCGCCTCCGTGGTGGTGCTAAGAAGAGGAAGA
AGAAGACTTACACCAAGCCTAAGAAGATTAAGCACAAGAAGAAGAAG
GTTAAGCTCGCTGTACTTCAGTTCTATAAGGTGGATGATTCTGGAAA
AGTCCAGAGGCTTCGTAAGGAGTGTCCTAATGCCGAGTGTGGTGCTG
GAACTTTTATGGCTAACCACTTTGACCGTCACTACTGTGGTAAGTGT
GGGCTCACCTATGTTTACAACAAGGCCGGCGCCGATTGAGGCTTATG
CTTAGCTCTGTTTTAATGCTGTCGTCAATTTTATCCTTTTGTCGAAC
GGTAATTTAGTATGGATTTTccTTTTTAAATGgtgtggtaACTATGG
gaattttGAGTTATTTTTAAggtttTGcttATTattcttG

SEQ ID NO:502 38919    126584_300464_1
gtagaagatcgcTGGTGAGGGGCGGAGAAAATGCAGATCTTCGTGAA
AACTCTGACCGGTAAAACTATAACCCTTGAGGTTGAATCCAGTGACA
CAATTGACAATGTCAAGGCCAAAATTCAAGACAAGGAAGGAATTCCA
CCAGACCAACAAAGGCTGATTTTTGCTGGTAAGCAGCTTGAAGATGG
CCGTACCCTTGCTGACTATAACATTCAGAAAGAGTCGACTCTGCATT
TGGTACTGAGGCTTCGTGGTGGAATTATTGAACCATCTTTGATGGCT
TTGGCTAGGAAGTACAATCAGGACAAAATGATTTGCCGCAAGTGCTA
TGCTCGTTTGCATCCTCGTGCTGTCAATTGTCGCAAAAAGAAGTGTG
GCCACAGTAACCAGTTGAGGCCCAAGAAGAAGATCAAGTAGATGGTG
ATTTTGAAGTCCTTTCAACATGTAGCTGCTAATGTTGAGATCCTTAA
GAAAATTATTAGATATGTTGTTGGGTTGCCTGTTCAATTTACTATAA
AATATTGATGGATATGTTTTTGAGCTACTTTCATATTTCTTAATGAG
CTaGaTTCTGATGGTTTCATTACc

SEQ ID NO:503 38919    254507_301633_1
ttgctttctctctctctgtctctctctttctgtctaccctttctct
cTCTGTCCTCTGTTTGAGCCAAGAAGAAGATGCAGATCTTCGTGAA
GACCCTGACCGGCAAGACCATCACCCTCGAGGTCGAAAGCTCCGAC
ACCATTGACAACGTCAAGGCCAAGATCCAGGACAAGGAGGGAATCC
CCCTGACCAGCAGCGCCTCATCTTTGCCGGTAAACAGCTCGAAGA
TGGCCGCACCCTTGCCGATTACAACATACAGAAGGAGTCTACCCTC
CACCTTGTCCTTCGCCTCAGGGGCGGTATGCAAATCTTCGTCAAAA
CCCTCACTGGCAAGACCATTACCCTTGAAGTCGAGAGTTCTGATAC
CATCGATAATGTGAAAGCCAAGATCCAAGATAAGGAGGGAATTCCC
CCTGACCAGCAGCGCCTTATCTTTGCTGGTAAACAGCTTGAAGATG
GCCGCACCCTCGCTGATTACAACATACAGAAGGAGTCTACCCTCCA
CCTTGTCCTTCGCCTCAGGGGTGGTATGCAAATCTTCGTCAAAACC
CTCACCGGCAAGACCATTACTCTTGAAGTCGAGAGTTCTGACACAA
TTGATAACGTGAAAGCCAAGATCCAAGATAAggAGGGAAttccCCC
CGAccAGCAGAGGCTCATCTTTGCTGGGAAGCAACTtgaagAtggT
CGCA FIGURE 9xx SEQ ID NO:504 38919     204284_300791_1
ATACAAACACTTCTCACATCTCTTCCACCCTAAGGAATATCCGTTA
ACAGCGCATCTTCTTGCACTCTCTACGAATCTCCCAGCGGCCAACG
CTTAATCCGCCACCATGCAAATCTTCGTCAAGACCCTCACCGGCAA
GACCATCACCCTCGAGGTCGAGTCTTCCGATACCATCGACAATGTG
AAGTCCAAGATCCAGGATAAGGAAGGCATTCCTCCTGACCAGCAGC
GTCTGATTTTCGCTGGCAAGCAACTCGAGGATGGCCGAACTCTGTC
CGACTACAACATCCAGAAGGAGTCCACCCTCCACCTGGTCCTCCGC
CTTCGTGGTGGTATGCAGATCTTCGTCAAGACCCTCACTGGAAAGA
CCATCACCCTCGAGGTGGAGTCATCTGATACCATCGACAACGTCAA
GTCCAAGATCCAGGACAAGGAGGGTATCCCTCCTGACCAGCAGCGA
CTGATCTTCGCTGGTAAGCAGCTTGAGGATGGCCGAACCCTCTCCG
ACTACAACATCCAGAAGGAGTCCACTCTCCACCTTGT*CCTTCGTC
TCCGTGGTGGTATGCAGATCTT*CGTCAAGACGTTGACCGGCAAGA
CCATCACATTGGAGGTTGAATCATCAGACACCATCGACAATGTCAA
ATCAAAGATTCAGGACAAGGAGGGTATTCCCCGGATCAGCAGCGT
CTTATCTTTGCTGGCAAGCAGCTTGAGGACGGTCGCACCTTGAGCG
ACTACAACATTCAGAAGGAGAGCACACTTCACCTTGTCCTCCGTCT
TCGTGGTGGTATGCAGATTTTCGTCAAGACTCTGACCGGCAAGACA
ATCACCCTCGAGGTGGAATCTTCCGACACCATCGACAACGTTAAGT
CCAAGATTCAGGACAAGGAGGGCATTCCTCCTGACCAGCAGCGCTT
GATCTTTGCTGGTAAGCAGCTGGAagaCGGTCGCACCTTGAGCGAC
TACAACATCCAGAAGgagagCACACTGCACTTGGTCCTgcgTCTGC
GTGGtggccagTAAATGTGTCTTTTgctTAcgaccGCACTgttAcg
aCTGAATTGGACGGTTGGGCGTTTTGggaACTTTTTttcaaaGCA
gATATgggaac SEQ ID NO:505 38919     193767_300742_1
cccggaccttgcTCCACACCCGCAGCAGCAGCAGCAAGGAGAA
GAAGAAGAGCCAAGATGCAGATCTTCGTGAAGACCCTAACGGGGAA
GACCATCACGCTCGAGGTCGAGAGCAGCGACACCATCGACAATGTC
AAGGCCAAGATCCAGGACAAGGAAGGCATCCCTCCGGACCAGCAGC
GCCTCATCTTCGCCGGCAAGCAGCTGGAGGATGGCCGCACCCTGGC
CGACTACAACATCCAGAAGGAGTCCACGCTCCACCTCGTCCTCCGC
CTCCGCGGTGGCATCATCGAGCCCTCCCTCCAGGCCCTCGCCCGCA
AGTACAATCAGGACAAGATGATCTGCCGCAAGTGCTATGCTCGGCT
GCACCCCAGGGCTGTCAACTGCCGCAAGAAGAAGTGCGGCCACAGC
AACCAGCTGAGGCCCAAGAAGAAGATCAAGAACTAGAGTTTGAGAT
ATCATTTCCGCGGATCATTGAAATCAACAGGAAGATCAGAGTTTAA
GTTTTTTTGTAGTGTAATGCCTCATGTTGTATGCCGAACTTTCTGT
TTATCCTGTTGTATGTTAACCTTGGTTACGCTGGAGAGTACTCCAG
CTTATTTTGATGACATAATTGACTAcaaAGTcaaggttATATGGtc
cggCCTtaaTTTTTGtcCCCCTtCG SEQ ID NO:506 38919     182929_300664_1
gaattcggaggatcttcttcaattctccttcaagatgcagatcttt
gtgaaaactcttactggtaagaccatcacccttgAGGTCGAGAGCT
CAGACACAATTGACAACGTTAAGGCTAAGATTCAAGACAAGGAAGG
AATTCCTCCAGACCAACAACGTTTGATCTTCGCCGGAAAGCAGTTG
GAAGATGGAAGAACTTTAGCTGACTACAACATCCAGAAGGAATCAA
CTCTCCATCTTGTCCTTCGTCTTAGAGGTGGTATGCAAATCTTTGT
CAAAACCTTGACTGGTAAGACCATCACTTTGGAAGTCGAGAGCTCT
GACACCATTGATAACGTTAAGGCTAAGATTCAAGATAAGGAAGGAA
TTCCTCCAGACCAGCAACGTTTGATCTTCGCCGGAAAGCAGTTGGA
AGATGGTCGTACTCTTGCCGACTACAACATCCAGAAGGAGTCTACT FIGURE 9yy CTCCATTTGGTTCTTCGTCTCAGAGGTGGTATGCAGATTTTCGTCA
AGACCCTTACTGGAAAGACCATCACCTTGGAGGTTGAGAGTTCCGA
CACCATCGATAATGTCAAGGCTAAGATTCAAGATAAGGAGGGTATC
CCCCCAGACCAGCAACGTTTGATCTTCGCCGGAAAGCAGCTGGAAG
ATGGTCGCACTCTTGCCGACTACAACATTCAGAAGGAGTCTACCCT
CCATTTGGTGCTTCGTCTTagaggtggTATGCAAATCTTCGTgaag
acCTTGACCgGAaaGAccATCACTCt SEQ ID NO:507    38919        167370_300546_1
gaattcataatcgatcagattcttctaggcagtcttattcggcgat
ctaacctaaatttcttcgacacctctctgaagatGCAGATTTTTGT
GAAAACCCTCACTGGCAAGACCATCACACTTGAGGTTGAGAGCTCA
GACACAATTGACAACGTGAAAGCTAAGATTCAAGATAAGGAAGGAA
TTCCCCCGGATCAGCAGAGGTTGATCTTTGCTGGCAAACAGTTGGA
AGATGGAAGAACTCTAGCTGACTACAACATCCAGAAAGAATCCACT
CTCCATCTCGTCCTCCGTCTCAGAGGTGGTATGCAAATATTTGTGA
AAACCCTCACTGGCAAGACCATTACTTTGGAAGTGGAGAGTTCTGA
TACCATCGACAATGTCAAGGCCAAGATCCAAGATAAGGAAGGTATT
CCTCCAGACCAGCAGAGGTTGATTTTTGCTGGGAAGCAGTTGGAAG
ATGGGCGTACCCTTGCTGACTACAACATCCAGAAGGAATCCACCCT
TCACCTGGTTCTACGACTAAGAGGTGGTATTGCAGATCTTTGTGAA
AACGCTTACTGGAAAGACCATCACCTTAGAAGTTGAGAGTTCAGAT
ACCATTGACAATGTAAAAGCCAAAATTCAGgACAAGgaaggtATTC
CTccagaccAGCAACGTTTGA SEQ ID NO:508    38919        157371_301737_1
ggaaaaaggaagccGGAGCTCGTAACGAAAATGCAGATATTCGTGAA
AACTCTCACTGGTAAAACCATTACTCTCGAAGTTGAATCCAGTGATA
CAATCGACAATGTTAAAGCCAAAATACAAGACAAAGAAGGAATTCCA
CCGGACCAACAAAGGCTGATTTTTGCTGGTAAGCAGCTCGAAGATGG
ACGCACCTTGGCCGATTACAACATCCAAAAAGAATCGACTCTACATT
TGGTGCTGAGGCTTCGTGGTGGAATCATTGAACCATCGTTGATGGCT
TTGGCTAGGAAATACAATCAGGACAAGATGATATGCCGCAAGTGCTA
TGCTCGATTGCATCCCCGTGCTGTCAATTGCCGCAAGAAGAAGTGTG
GACACAGCAACCAGTTGAGGCCTAAAAAGAAGATTAAGTAGATGTAA
ATTTCTATTGCTGCGGACTTGTAGTTGTTGGCGGTATTAGATCTTTC
AGAAACTGAACTTGGATTTCTTACCAAAAAAACAAATTGTACTTGGG
TTTATCTTTGGGTTTCTGTTCTTTTTACCCCTTAagaTtCATGGCTT
GTATTTGGGAggTaaATGAAATCAATCAGTATACTATAATTGCTAtT
TTGCttT SEQ ID NO:509    38919        156472_301366_1
gcaaaaatattcttctgcttttccttctctaagaagcgttggattcc
caaaaaccgtttcaaagatgcaaatcttgtaaaGACCCTCACTGGCA
AAACCATCACTCTCGAGGTTGAGAGTTCAGACACTATCGACAATGTT
AAGGCAAAGATCCAAGATAAGGAAGGAATTCCTCCAGATCAGCAAAG
GTTGATCTTTGCTGGAAAGCAGTTAGAGGATGGCCGAACTCttgctG
ACTACAATATCCAAAAGGAGTCTACCCTCCACcttgtcCTTCGTCTG
CGTGGTGGTATGCAGATCTTTGTAAAAACTTTAACAGggaagACTAT
CACTCTCGaggTTGAGAGCTCGGACACAATTGATAATGTTAAGGCAA
AGATTCAGGACAAGGAAGGCATTCCTCCGGATCAGCAAAGATTAATA
TTCGCCGGTAAACAGCTAGAAGATGGCCGTACCTTGGCCGATTACAA
CATTCAGAAAGAATCAACCCTTCATTTGGTTCTCCGTTTAAGAGGTG
GTATGCAAATCTTTGTCAAGACTCTGACTGGCAAGACCATTACTTTG
GAGGTTGAGAGCTCTGACACTATTGACAACGTCAAAGCAAAGATCCA FIGURE 9zz

```
GGACAAGGAAGGAATCCCTCCGGATCAGCAGAGACTTATCTTTGCCG
GTAAGCAGCTTGAAGACGGAAGAACTCTTGCTGACTACAACATTCAA
AAGGAGTCGACCCTTCATTTGGTGCTTCGTCTCAGaGgTGGTATGCA
AATCTTTGTCAAGACCCTCACTGGTAAAACAATCACCCTTGAGGTTG
AGAGTTCAGACACCATTGACAATGTCAAAGCTAAGATCCAAGATAAA
GAGGGAATTCCTCCGGATCAGCAGAGGCTTATCTTTGCCGGTAAGCA
GCTCGAAGATGGACGCACCCTTGCAGATTACAACATCCAAAAGGAGT
CGACACTTCATCTTgtgCTTCGTCTCCGTGgtgGTATGCAGATCTTT
GTGAAGACCCTTACCGGAAGACCATTACTCTGGAGGTTGAAAGCTC
AGACACCATCGATAATGTCAAGGCTAAGATTCAGGACAAGGAAGGGA
TCCCACCAGaCCAACAGAGACTCATCTTCGCTGGAAAACAGCtTgAg
gATGGTCGCACACttgcaGATTACAACa
```

SEQ ID NO:510  38919     111917_300050_1
```
cccacgcgtccgGGGTAAACTGAAGAGTGCGCCGCAAAATGCAGATCT
TCGTGAAAACCCTAACCGGGAAGACAATCACGCTCGAGGTTGAATCGA
GCGACACCATTGATAATGTCAAGGCTAAGATTCAAGACAAAGAAGGTA
TTCCACCGGACCAGCAGCGGTTGATATTCGCCGGAAAGCAGCTCGAAG
ATGGACGTACTCTTGCTGATTATAACATCCAGAAAGAGTCAACTTTGC
ATTTGGTTTTGAGGCTTCGTGGAGGGATTATTGAGCCTTCTCTGATGG
CTTTGGCTAGGAAGTACAACCAGGATAAGATGATTTGTCGCAAGTGCT
ATGCTCGCCTGCATCCTCGTGCTGTTAACTGCAGGAAGAAAAAATGTG
GGCACAGCAACCAGCTGAGGCCAAAGAAGAAGATCAAGTAGACGTGAT
GTCTTTTCTAAGCTTAGATCAATTTTGCGCGTTGCAGCTATATATTGC
CAGTCCGTTGTTTTTACAGTTTTCAGTCCTGCTTCAATTTGATGTCAT
GGATAACAAACATGTCTTAAACATCTAATTATTGGATAAGATATCTTT
GTGCACTCAATATATGTCT
```

SEQ ID NO:511  38919     113036_300021_1
```
TCATTATCTCCTCAACTTTTCTCTCTTTATTCAAACGCCTCTCAAGAT
GCAGATCTTCGTCAAAACCCTAACTGGAAAGACGATAACCCTTGAGGT
TGAAAGCTCCGACACAATTGACAACGTTAAGGCGAAGATTCAGGACAA
GGAAGGAATTCCACCGGATCAGCAGAGGCTGATCTTCGCCGGAAAGCA
GCTCGAAGACGGCAGAACCCTAGCCGACTACAACATCCAGAAGGAATC
GACTCTTCACTTGGTGCTCCGTCTTCGTGGCGGTATGCAAATCTTCGT
CAAAACCCTAACAGGGAAAACAATCACCCTTGAAGTTGAAAGCTCCGA
CACTATTGATAACGTTAAGGCGAAAATCCAGGATAAGAGGGAATCCC
ACCAGATCAGCAGAGGTTGATCTTTGCTGGCAAACAGTTGGAAGACGG
CAGAACCCTAGCCGACTACAACATTCAGAAGGAATCAACTCTTCACTT
GGTACTCC*GTCTTAGAGGAGGCATGCAAATCTTCGTCAAAACCCTAA
CCGGGAAAACAATCACCCTTGAAGTCGAAAGCTTTGACACAATTGACA
ATGTCAAGGCGAAGATTCAGGACAAGGAAGGAATCCCACCAGATCAGC
AGAGGTTGATCTTTGCGGGTAAGCAATTGGAAGATGGAAGGACCTTAG
CTGATTACAATATTCAGAAGGAGTCCACCCTCCATTTGGTGCTCCGTC
TTCGTGGTGGAATGCAGATTTTTGTGAAGACTTTGACCGGGAAAACAA
TCACTCTTGAAGTTGAAAGCTCAGATACTATTGACAACGTTAAGGCCA
AGATCCAGGATAAGGAGGGTATCCCACCAGATCAGCAAAGGCTGATCT
TTGCTGGCAAGCAGTTGGAAGATGGTCGTACTCTTGCTGATTACAACA
TTCAGAAGGAGTCGACTTTGCACCTTGTCCTCCGTCTCCGTGGTGGTT
TCTAAAGTGTCCGTCAGTGGTGGTGGTGATGTCTGTGTCTGTGTCTTG
GGTCTTTGGTCTGTTTGGTGTTTGTTTGATTCATGATTTAGTACTTTG
TGTAGTTTCTGTTAGTTGTTATCATGTTATCTTTCCAATAGAGGCGAG
GAGTCTTGTTTTCTTCTGTCTCTGTTTGTGAATAATAAAGTCGAATTA
TTG
```

FIGURE 9aaa

SEQ ID NO:512 38919      56456_300139_1
TtACAATATCCAgaagGAATCCACCCTCCACTtggTTCTcaggCTCCg
TGGTGGTATGCagaTTTtcgTTAAAACCCTAacggtaAagacgatTAC
tctTGAGGTggAGAgctCTGAcacCATTGACatCGTCAAGGCCAAGAT
CCAAGATAAGGAGGGTATTCCTCCGGACCAGCAGAGGTTGATCTTCGC
CGGAAAGCAACTTGAGGACGGCAGAACTTTGGCGGATTACAACATCCA
GAAGGAGTCTACGCTTCATTTGGTCTTGCGTCTGCGTGGAGGTATGCA
GATCTTCGTAAAGACTTTGACCGGAAAGACCATCACTCTTGAAGTTGA
GAGCTCCGACACCATTGATAACGTGAAGGCTAAGATCCAGGACAAGGA
AGGCATTCCTCCGGACCAGCAGCGTCTCATCTTCGCTGGAAAGCAGCT
TGAGGATGGACGTACTTTGGCCGACTACAACATCCAGAAGGAGTCTAC
TCTTCACTTGGTCCTCCGTCTCCGTGGTGGTTTCTAAACCTTGTCTCT
CTCTCTTATGGTTACTGAACCAAGTTCATGTATCGTTTCATCTAGTAC
TTTGGTGGTTTATGTTTTGGGGCCATGTACAGCCTCTGATAAATAATT
GATCGACTATGTTTCCGTTA

SEQ ID NO:513 38919      49945_300189_1
TTCGCCGGAAAACAACTTGAAGATGGCAGAACTTTGGCCGACTACAAC
ATTCAGAAGGAGTCCACACTCCACTTGGTCTTGCGTCTGCCGGGAGGT
ATGCAGATCTTCGTGAAGACTCTCACCGGAAAGACCATCACTTTGGAG
GTGGAGAGTTCTGACACCATTGATAACGGGAAAGCCAAGATCCAGGAC
AAAG

SEQ ID NO:514 38919      46816_300192_1
AAAACCCTCACCGGAAAAACCATAACCCTAGAGGTCGAAAGCAGCGAC
ACCATCGACAATGTCAAAGCCAAAATTCAGGACAAAGAGGGAATACCA
CCTGATCAACAGAGGTTGATATTTGCTGGTAAGCAGCTTGAAGATGGT
AGAACATTAGCGGATTACAACATTCAGAAAGAATCGACTCTTCACTTG
GTATTGAGGCTTAGGGGTGGGACTATGATTAAGGTGAAGACTCTCACA
GGGAAGGAAATTGAGATTGATATCGAACCAACCGATACTATTGATCGG
ATTAAGGAACGTGTTGAGGAGAAAG

SEQ ID NO:515 38919      4655_300310_1
CGCGGTATGCAGATCTTCGTGAAGACTCTCACCGGAAAGACTATCACT
TTGGAGGTAGAGAGCTCTGACACCATTGACAACGTGAAGGCCAAGATC
CAGGATAAGGAAGGAATCCCTCCGGACCAGCAGAGGTTGATCTTTGCC
GGAAAACAATTGGAGGATGGTcgtaCTTTGGCGGATTACAACATCCAG
AAGGAgacgACCCTTCaCTTGgtgTTGCGTCTgcgagGAGGTATGCag
aaattcgTCAAgACtTtgaccggaAAgaccaTCACCCTTGAAGtggaa
AgctccgacaCCATTgac

SEQ ID NO:516 38919      248863_301587_1
tcatcaattaggtttcttcgatagcaagtagcgatgcagatcttcgtc
aagactctcaccggcaagactatcacctTGGAGGTGGAGAGCTCCGAC
ACCATCGACAACGTCAAGACCAAGATCCAGGACAAGGAAGGGATCCCT
CCGGATCAGCAGCGGTTGATCTTTGCCGGCAAGCAGCTTGAGGACGGG
CGTACCCTCGCCGACTACAACATCCAGAAGGAGTCTACGCTGCATCTT
GTTCTTCGGCTGCGAGGAGGTATGCAAATATTCGTCAAGACCCTAACG
GGTAAGACGATCACCCTGGAGGTGGAGAGCTCCGACACCATCGACAAC
GTCAAGACCAAGATCCAGGACAAGGAAGGGATCCCGCCGGATCAGCAG
CGTCTGATCTTCGCTGGCAAGCAGCTCGAGGATGGCCGTACCCTGGCC
GACTACAACATCCAGAAGGAGTCGACCCTTCATCTTGTGCTGCGTCTG
CGAGGAGGCATGCAGATCTTCGTTAAGACCCTCACTGGTAAGACGATC
ACCCTGGAAGTCGAGAGCTCGGACACCATCGACAACGTGAAGACTAAG
ATCCAGGACAAGGAGGGAATTCCTCCGGACCAGCAGCGGTTGATCTTC FIGURE 9bbb GCGGGTAAGCAGCTCGAGGATGGGCGCACTCTTGCCGACTACAACATT
CAGAAGGAGTCTACACTCCATTTGGTGCTGCGTCTTCGCGGAGGCATG
CAGATCTTCGTCAAGACCCTCACGGGTAAGACGATCACCCTGGAAGTC
GAGAGCTCAGACACCATCGACAACGTGAAGACCAAGATCCAGGACAAG
GAGGGAATTCCTCCGGATCAGCAGCGGTTGATCTTCGCGGGTAAGCAG
CTCGAAGATGGGCGCACTCTCGCCGACTACAACATTCAGAAGGAGTCT
ACTCTCCATTTGGTGCTGCGTCTTCGCGGAGGCATGCAGATCTTCGTC
AAGACCCTCACGGGTAAGACGATCACGTTGGAGGTGGAGAGCTCGGAC
ACGATTGACAACGTGAAGACCAAGATCCAGGACAAGGAGGGAATTCCT
CCGGACCAGCAGAGGCTGATCTTCGCCGGGAAGCAGCTCGAGGATGGC
CGCACTCTTGCGGACTACAACATCCAGAAGGAGTCTACTCTCCATTTG
GTGCTCCGTCTTCGTGGAGGCCAGTAGATAGCATGTAGCGCgttagCG
CGTGAAGTAt SEQ ID NO:517 38919      234660_301219_1
cgacccacgcgtccgcttttgtgggcgattccTGGGTAATTTCATACA
GCGGCAACTATGCAGATCTTCGTCAAGACACTGACTGGCAAGACGATC
ACTCTGGAGGTCGAGAGCTCGGACACGATCGATAATGTGAAGACCAAG
ATCCAGGACAaggaaGGGATCCCCCggaCCAGCAGCGTCTCATCTTC
GCCGGGAAGCAGCTCGAAGACGGGCgaatcttggcTGACTACAACATC
CAGAAGGAATCCACTCTCCATCTCGTCCTACGTCTTCGCGGAGGCATG
CAGATCTTTGTCAAGACGCTGACCGGCAAGACCATCACTCTGGAGGTC
GAGAGCTCGGACACGATCGATAATGTGAAGACCAAGATCCAGGACAAG
GAAGGGATCCCCCCGGACCAGCAGCGTCTCATCTTCGCCGGGAAGCAG
CTCGAAGACGGGCGAACCTTGGCTGACTACAACATCCAGAAGGAATCG
ACTCTCCATCTCGTCCTACGTCTTCGCGGAGGCATGCAGATCTTTGTC
AAGACGCTGACCGGCAAGACCATCACTCTTGAGGTCGAGAGCTCGGAC
ACGATCGATAATGTGAAGACCAAGATCCAGGACAAGGAAGGGATCCCC
CCGGACCAGCAGCGTCTCATCTTTGCTGGGAAGCAACTCGaagacgGG
CGAACcttggccGACTACAaCATCCagaaggaGTCGAccCTTCACTTg
gt SEQ ID NO:518 38919      224458_300972_1
gGTGATTTCTAAACATGCAGATcTTTGTGAAGACCTTGACCGGCAAGA
CTATCACCCTCGAGGTGGAGAGCTCGGATACCATCGACAACGTTAAGA
CCAAGATCCAGGACAAGGAAGGGATCCCACCGGACCAGCAACGATTGA
TCTTCGCCGGGAAGCAGCTTGAGGACGGACGGACCCTTGCGGACTACA
ACATCCAGAAGGAATCCACGCTTCACCTGGTTCTTCGTCTCCGCGGTG
GCATGCAGATATTTGTGAAGACCTTGACCGGCAAGACCATCACCCTCG
AGGTGGAGAGCTCGGATACCATCGACAATGTCAAGACCAAGATCCAGG
ATAAGGAGGGGATTCCTCCGGACCAGCAGCGACTTATCTTCGCCGGGA
AGCAACTCGAGGACGGACGGACCCTTGCCGACTATAACATCCAGAAGG
AGTCGACTCTCCACTTGGTTCTTCGTCTCCGCGGTGGCATGCAGATAT
TTGTGAAGACACTGACCGGCAAGACCATCACCCTCGAGGTGGAGAGCT
CCGACACGATTGACAACGTTAAGACGAAAATCCAGGACAAGGAAGGGA
TCCCTCCTGACCAGCAGCGCCTCATCTTCGCCGGCAAGCAGCTCGAGG
ATGGACGAACTCTCGCCGACTACAACATCCAGAAGGAATCCACCCTTC
ACCTGGTGCTGCGTCTCCGCGGAGGCATGCAAATCTTCGTCAAGACCC
TGACCGGCAAGACCATCACGCTCGAGGTCGAGAGCTCCGACACGATCG
ACAACGTAAAGACCAAGATCCAGGACAAGGAAGGGATCCCCCCGGACC
AGCAGCGACTCATCTTTGCCGGGAAGCAGCTCGAGGATGGCAGGACTC
TGGCCGACTACAACATCCAGAAGGAATCCACCCTTCACCTGGTGCTGC
GTcTCCGCGGAGGCATGCAAATCTTCGTCAAGACCCTGAccGGCAAGA
CCATCACTCTGGAGGTggagagctcggATACCATCgaCAAcGT

FIGURE 9ccc

SEQ ID NO:519 38919      220302_300954_1
tccgcaacatctgaagattgcttaggacggcaataggtctattgtcga
ggtatgtctgaaagatgctgcatttctatctgCCCTCCATGAGCTCCG
GGAGCTTCATGAGGGAATCATCGTTGATGTCTCCCTCTTGAGCATTCT
TCTTTGTTTCCCGGAGCTCTATTCCCCAAATCCCGAGATATTGCTCGT
TGTCGCGAAGAAATTTGCAACACGGCAATTCTCGCCTTCTTCTCCCCA
AAGTCAACTCACGCAGGCAATGTATGCTGGGCAAACAAATCTAACCCT
TCCAGTTAGGCAAGATGCAGATTTTCGTCAAGACCCTCACGGGGAAGA
CGATCACCCTTGAGGTGGAGTCTTCCGACACCATCGACAATGTCAAGT
CCAAGATCCAGGACAAGGAGGGCATTCCCCCGGACCAGCAGCGATTGA
TCTTCGCTGGTAAGCAGCTGGAGGATGGCCGAACCCTCTCCGACTACA
ACATCCAGAAGGAGTCTACCCTCCACCTGGTCCTGCGCCTGCGTGGTG
GTGCCAAGAAGAGAAAGAAGAAGGTCTACACCACCCCAAGAAGATTA
AGCACAAGCGCAAGAAGACCAAGTTGGCTGTCCTCAAGTACTACAAGG
TCAGCAACGATGGTAACATCGAGCGTCTCCGCCGCGAGTGCCCCAGCG
AGACTTGCGGTGCTGGTGTCTTCATGGCTGCCATGCCTGACCGTCAAT
ACTGTGGTCGTTGCCACCTGACCTACGTCTTCGACAAGCAGTAAACGA
CAAAACTTTCAAAAAGGGAAAAAATTTATTGTGGATTGGACAGCTGGA
GCCATGGGACTGCCATAACACACAAAGGCGTTGATGTAGCATTAGAGA
GCACATCCGGCGGCTTCTGGTAATGAATgcttgaTTtgagacacgtTT
GG

SEQ ID NO:520 38919      208674_300807_1
gcatcacaaaaATCGTTCAAGATGCAGATTTTCGTGAAGACCCTGACG
GGCAAGACCATCACCCTTGAGGTCGAGTCCTCCGACACGATCGACAAT
GTCAAGTCCAAGATCCAGGACAAGGAGGGCATTCCCCCGGACCAGCAG
CGATTGATCTTTGCTGGCAAGCAGCTCGAGGATGGCCGCACCCTTTCC
GACTACAACATCCAGAAGGAGTCCACCCTCCACCTCGTCCTCCGTCTG
CGTGGTGGTGTCATTGAGCCCTCTCTGAAGGTTCTTGCCTCCAAGTTC
AACTGCGACAAGATGATCTgccGCAAGTGCTACGCCCGTCTCCCTCCC
CGTGCCACCAACTGCCGTAAGCGAAAGTGCGGTCACACCAACCAGCTC
CGACCCAAGAAGAAGCTCAAATAAATCATTTCACCAAGGATGTGGCGT
CTGGGTTATGGcaTTCTGGGGTGGcgaggACagAGGTGCTTCTGCTTT
ATTCCGGAttTtggttCTACAttAGCATCAGggcagaggcaaAATATA
TCaATCT

SEQ ID NO:521 38919      207548_300806_1
GACCGAAGGGGAGGGGGAGCGAAGCTTTGCGTTCTCTAATCGCCTCGT
CAAGATGCAGATATTCGTTAAGACCCTCACTGGCAAGACCATCACCTT
GGAGGTTGAGTCCTCCGATACGATTGACAATGTGAAGGCTAAGATTCA
GGACAAGGAGGGCATCCCTCCGGACCAGCAACGCCTTATCTTCGCTGG
CAAGCAGCTTGAGGATGGGCGTACTCTCGCGGATTATAACATCCAGAA
GGAGTCCACCTTGCACCTTGTCCTCCGCCTTCGTGGAGGCATGCAAAT
ATTCGTGAAGACCCTCACCGGCAAGACCATTACCCTGGAGGTCGAGTC
CTCCGACACGATCGATAATGTGAAGGCCAAGATCCAGGACAAGGAGGG
AATCCCACCAGACCAGCAGCGTCTCATCTTTGCTGGGAAGCAGCTCGA
GGATGGCCGCACCCTTGCAGACTACAACATCCAAAAGGAATCCACCCT
GCACCTTGTCCTGCGCCTCCGGGGCGGTATGCAGATCTTTGTGAAGAC
CCTTACTGGCAAGACGATCACCTTGGAGGTTGAGTCCTCTGACACGAT
CGACAATGTGAAGGCCAAGATCCAGGACAAGGAGGGTATTCCACCAGA
cCAGCAgcgCCTCATCTTCGCTGGCAAGCA FIGURE 9ddd

SEQ ID NO:522 38919     1113020_301794_1
GAGAGAGAGAGAGAGAGAGAGAAGATGCAGATATTCGTGAAGACCCTG
ACGGGGAAGACCATCACCCTAGAGGTCGAGAGCAGTGACACCATCGAC
AATGTCAAAGCCAAGATCCAGGACAAGGAAGGCATCCCCCCTGATCAG
CAACGACTTATCTTTGCCGGCAAGCAGCTGGAAGATGGCCGGACATTG
GCAGACTACAATATCCAGAAAGAATCCACCTTGCACCTTGTTCTGAGG
CTCCGAGGTGGTATCATCGAGCCTTCACTGATGGCACTGGCTAGGAAG
TACAATCAAGAGAAGATGATATGCCGCAAATGTTATGCCCGCCTCCAT
CCTCGTGCAGTGAACTGCAGAAAGAAGAAATGTGGACACAGCAATCAG
CTTCGCCCTAAGAAGAAGATCAAGTAGATTTGACGCATCCTTCGGAGA
GATTGAGGACCTATAACATTAGTGAGAGTGTTTTTTTGATTATCTATT
GCCAGAATTGAATTTAGACACTGGTCTCCCATCGGAACTTTTCTAATA
TTATATAATCAGTACTTTTTgttgaaccAATAGCGTGttgATCTTTTC
ATCCTTTTCaaCATATGgaattgtgTcggGGTTAA

SEQ ID NO:523 38919     1044002_301885_1
cacgcgtcgcccacgcgtcgctcttctcttgtggtatctctctctctc
tctctctctctctttcctgagaaaatgcagatCTTGTGAAGACCCTGA
CAGGGAAGACCATCACCCTGGAGGTGGAAAGCTCCGACACCATCGACA
ACGTCAAGGCCAAGATCCAAGACAAGGAGGGCATCCCCCCTGACCAGC
AGCGCCTCATCTTCGCTGGGAAACAGCTCGAAGATGGCCGTACCCTCG
CTGACTACAACATCCAGAAGGAGTCCACTCTCCACCTTGTCCTCCGCC
TCCGAGGTGGTATGCAAATCTTTGTCAAAACCCTCACTGGTAAGACCA
TCACCCTTGAAGTCGAGAGCTCTGATACTATTGACAATGTCAAGGCCA
AGATCCAAGACAAGGAGGGGATTCCCCCTGACCAGCAGAGGCTCATCT
TTGCTGGGAAGCAGCTTGAAGATGGGCGGACCCTTGCCGACTACAACA
TCCAGAAGGAGTCCACCCTCCACCTTGTGCTGAGGCTCCGGGGGGGCA
TGCAGATCTTCGTCAAAACTCTAACAGGGAAGACGATAACGCTGGAGG
TGGAAAGCTCTGACACAATTGACAATGTGAAGGCAAAGattcaAGAcA
AGGAAGggatcCCCctgaccAGCAGcgAttgAtCt

SEQ ID NO:524 45801     258372_301691_1
ACGCGTCGGTTTGTTCTTGCTGTAGGGCGCGAGATTTGGATCGATCCA
TTGCCGCCGCGCGATGGGTGTGAAGATTAGATTCGCTCGTTTTGGAAG
GAAAAAGCTGCCCTTCTATCGAATCTACGTCGCGGACAGCCGATGCAA
GCGTGACGGCAGATTTTTGGAGAATGTAGGCTACTACAATCCCATTAC
TGGCAAAGATGGTGAGAAGCAATTCGCCATCAAGTCGGACCGAGTCAA
ATATTGGATCTCCGTTGGAGCACAGCCTTCCAACGCTGTTGCGAGGCT
TTTGGCAAGAACAGGTAACCTTCCAACAGCGTATCCTCAGGGGCCGAC
GCGATCATCACCATCTCCTTCGGCGGCGCCGGCGGCGGACGACAAGCC
GGACATGACCATCTCCGCCAAGCTCTCCGCCTCGCCGGCTCCAATGCT
GGCCGCCAGGACACTCTGCTTCTGCTGACGACGTAGACGTCGACGAAT
CGAGCAAGAGCAAAATACTACAAAGAGGTTTGACATTTTTATCTAAAT
TATTTAAGTTAGCTCTCGAAGTAAGCTCTGACTCTTGATAGCGATGGA
GTTCTT

SEQ ID NO:525 45801     51021_300116_1
CTCGAGCTTGCGGCCGCCTCGCGCGTCTTGGTTGTAAACACCGACCCT
TCTATCGTGTAGTTGTCGCCGATGAAAAATCGCGCAGGGACGGTAAAC
AAATCGAGGTGTTAGGCTTTTATGATCCACTCCAAGGCAAAGAAGATG
CGGATAGAGTGAGCCTCAAATTCGACAGAATCAAGTACTGGTTATCTG
TTGGAGCTCAACCAACAGACACAGTGGAAAGCATGCTTTTCAGGGCCG
GTTTGATACCACCAAAGCCTATGGTAGTGGTCGGTTCGAAAAATGGGC
AGAAGTCTACGAGCCAACATGTTTCACCCATTACAGGTGAAATCTTGA
ACTAAGAGTGTTGATGCGTTGAGCAAGAAAGAGCCTTTTGTGTCTGTG

FIGURE 9eee

```
TGAAAGGAGTTTATGTAATGTTGTTTAAGACTTTTCTGTTTATGTGAA
AGGAGTTAATGTAATGTTGTTTAAGACTTTTGCTTTCTATGTGAAAGC
AGTTTAATGTTATGTTGGTTAAGACGCGGCCGCCCGTATTATACATAA
AATCTCATGTATCTTTACATCAAACTTCAAATCTAAATACAAAAACAA
AAAGAACATCACTAGAGATGGATCTCTCGTCGGACAAAACCCCGAAGT
TTCGTCTTTCACGGTCAACTTTAGTCAAACTCCGATCCGAATCAAACC
aaAAAgggtTTTTCATTCATCGATCATAGTCATCATctcctTTTAGA
CAaAAGATTCTCAGCTTCTCTGGATCAT
```

SEQ ID NO:526   45804        1044152_301886_1
```
TTCTTGGCCATAGCCGTATATACGAGCTGAGAAATCGTCAAAATGTGT
GGTGGATCGATCATTTCGACCTTGTCGCTTCCTGATAGGGGTAAGGCC
TCCCTCGCCAAACCTCCTCTTCTTACCTTCCCCCCTGATGATGACTTG
GAATGGCTCTGTGGCCTGCCTGAATCCGAATCCATCAATGATGACGGA
TTCTTCCGCAAATTTCTCGATTCCAATAGTGAACTGCAGCAGGACATA
GCTGGCGTCTTTCCTGATCTGTGCTCTCCCGGTCTTGACAATTCTGAA
GAGGTCATTCCTGTTCCCACTCCCGCTCCCGCTCCCGTGAAAAGTAGG
AGTAGGAAGCACCTGTACCGAGGCATCCGGCAGAGGCCTTGGGGGAAA
TGGGCTGCAGAAATTCGTGACCCCAAAAAGGGTGTCAGGGTCTGGCTT
GGCACATTTGAAACAGCCGAAGAAGCTGCCCGTGCCTATGATACCGCA
GNCCGAAAGATCAGGGGCAGCAAGGCCAAGGTTAATTTCACCCAAGAA
ATCCCC
```

SEQ ID NO:527   45804        174859_300527_1
```
cccgatcacaagctcacaagttcagggcccaacacccaaaagcaaaag
aaaagcagcaaccaaagatgtgcggcggagcgATCCTTGCGGAGCTCA
TACCGAGCGCGCCGGCGGCGAGGCGCGTCACGGCGGGCCACGTCTGGC
CGGGCGACGCCAACAATGCCAAGAAGAAGGGCGCGCGCGCCGACGACT
TCGAGGCCGCGTTCCGCGACTTCGACAACGACTCCGATGACGAGGAGA
TGATGCTGGAGGAGGCGGAGGAGGAGGAGGCGACCTCCGAGCACAAGC
CGTTCGTCTTCCGCGCCAAGAAGGCGAGGAAGGCGGCGGCGGCGGCGG
CGTCGAGCAGGCGCAGGAAGCCGGCGCAGTACAGGGGCGTGCGGCGCC
GGCCGTGGGGAAGTGGGCGGCGGAGATCCGCGACCCCGTCGAGGGCG
TCCGCGTCTGGCTCGGCACGTTCGCCACCGCCGAGGCCGCCGCCCACG
CCTACGACGCCGCCGCCCGCGACCTCCGCGGCGCGACCGCCAAGCTCA
ACTTCCCCTCCTCCTCCTCCTCCACCGCCGCCACCCCACGCCCCCGCA
AGTGCCgcCCCACCACCGncACCGCCACCCCCAAGgCgacGAcACCGA
ACGTCGTCgtCgtcgtcaaCCTCGTCgacaaagAGgccGAGGTcagCG
AGagcTCCGGTGCCAGCAGcagcgcGCTGCCGGACTTCTCGTGGCAcg
gcaTG
```

SEQ ID NO:528   45804        263178_301722_1
```
GCAGCATGCCCTCTCGTCACCAAGGCCAAGGGCCGTAAACTCACGGC
TGAGGAACTCTGGTCAGAGCTCGATGCTTCCGCCGCCGACGACTTCTG
GGGTTTCTATTCCACCTCCAAACTCCATCCCACCAACCAAGTTAACGT
GAAAGAGGAGGCAGTGAAGAAGGAGCAGGCAACAGAGCCGGGGAAACG
GAGGAAGAGGAAGAATGTTTATAGAGGGATACGTAAGCGTCCATGGGG
AAAATGGGCGGCTGAGATTCGAGATCCACGAAAAGGTGTTAGAGTTTG
GCTTGGTACGTTCAACACGGCGGAGGAAGCTGCCATGGCTTATGATGT
TGCGGCCAAGCAGATCCGTGGTGATAAAGCCAAGCTCAACTTCCCAGA
TCTGCACCATCCTCCTCCTCCTAATTATACTCCTCCGCCGTCATCGCC
ACGATCAACCGATCAGCCTCCGGCGAAGAAGGTCTGCGTTGTCTCTCA
GAGTGAGAGCGAGTTAAGTCAGCCGAGTTTCCCGGTGGAGTGTATAGG
```

FIGURE 9fff

ATTTGGAAATGGGGACGAGTTTCAGAACCTGAGTTACGGATTTGAGCC
GGATTATGATCTGAAACAGCAGATATCGAGCTTGGAATCGTTCCTTGA
GCTGGACGGTAACACGGCGGAGCAACCGAGTCAGCTTGATGAGTCCGT
TTCCGAGGTGGATATGTGGATGCTTGATGATGTCATTGCGTCGTATGA
GTAA

SEQ ID NO:529 45804       316861_301427_1
GCAGCATGCCCCTCTCGTCACCAAGGCCAAGGGCCGTAAACTCACGGC
TGAGGAACTCTGGTCAGAGCTCGATGCTTCCGCCGCCGACGACTTCTG
GGGTTTCTATTCCACCTCCAAACTCCATCCCACCAACCAAGAGGAGGC
AGTGAAGAAGGAGCAGGCAACAGAGCCGGGGAAACGGAGGAAGAGGAA
GAATGTTTATAGAGGGATACGTAAGCGTCCATGGGAAAATGGGCGGC
TGAGATTCGAGATCCACGAAAAGGTGTTAGAGTTTGGCTTGGTACGTT
CAACACGGCGGAGGAAGCTGCCATGGCTTATGACGTTGCGGCCAAGCA
GATCCGTGGTGATAAAGCCAAGCTCAACTTCCCAGATTGCACCATCCT
CCTCCTCCTAA

SEQ ID NO:530 45804       316805_301427_1
GCAGCATGCCCCTCTCGTCACCAAGGCCAAGGGCCGTAAACTCACGGC
TGAGGAACTCTGGTCAGAGCTCGATGCTTCCGCCGCCGACGACTTCTG
GGGTTTCTATTCCACCTCCAAACTCCATCCCACCAACCAAGTGAAGAA
GGAGCAGGCAACAGAGCCGGGGAAACGGAGGAAGAGGAAGAATGTTTA
TAGAGGGATACGTAAGCGTCCATGGGAAAATGGGCGGCTGAGATTCG
AGATCCACGAAAAGGTGTTAGAGTTTGGCTTGGTACGTTCAACACGGC
GGAGGAAGCTGccATGGCTTATGATGTTGCGGCCAAGCAGATCCGTGG
TGATAAAGCCAAGCTCAACTTCCCAGAttGCACCATCCTCCTCCCCTA
A

SEQ ID NO:531 45804       188983_300611_1
AGGAGGAGGAGGCGACCTCCGAGCACAAGCCGTTCGTCTTCCGCGCCA
AgaAGGCGGCGGCGGCGGCGTCgagcAGGCGCAGGAAGCCGGCGCAGT
ACAGGGGCGTGCGGCGCCGGCCGTGGGGGAAGTGGGCGGCGGAGATCC
GCGACCCCGTCAAGGGCATCCGCGTCTGGCTCGGCACCTTCACCAACG
CCGAGGCCGCCGCGCTCGCCTACGACGACGCCGCGCGCGCCATCCGCG
GGGACAGGGCCAAGCTCaACTTCCCTTCCGCTACCACCCCTGACACCC
GC

SEQ ID NO:532 45804       111946_300050_1
cccacgcgtccggaaaaaagaaaaaagattactccgtcaaagacgaa
actgatttctgcAAAAAACTTTTCTGCTGAGAGAAAACATAAAGCAT
GTGTGGTGGTGCTATAATCTCCGATTACATTGCTCCGAGCCGGACTT
CTCGACGGCTCACCGCCGAGTTGCTATGGGGCCGGTCCGATCTGAGT
AAGAAGCAAAAAAATCCTACCGATTATCACTCCAAGCCGTTGAGATC
CCAAGTAGTTGACCTTGACGATGACTTCGAGGCTGATTTTCAGGACT
TCAAAGATTTCTCCGATGATGAGGAGGTTGAAGTCGATGTCAAGCCA
TTTGCCTTCTCTGCTTCGAAAACCTGTACTTTTGAAGGCTCCAAATC
TGTGAAAACTGTTTATTCAGACAAGGATGCTGATAGATCCTCTAAGA
GAAAGAGGAAGAATCAGTATAGGGGGATCAGACAGCGACCTTGGGGT
AAGTGGGCAGCTGAAATACGTGACCCAAGAAAGGGGTTCGGGTCTG
GTTGGGAACTTTCAATACTGCAGAAGAAGCTGCCAGAGCTTATGATG
TCGAGGCAAGGAGGATCAGAgCAATAAAGCCAAGGTAAACTTTCCC
GATGAAGCTCCAGTgccTgcctcAagacgTACTgttaaGCTGAATCA
tCa FIGURE 9ggg

SEQ ID NO:533 45820      108019_300057_1
agcagcagcaGCGCATTTCGAGAGCAGAGGAAGAAAATGCCGGCAGGT
CACGGATTGAGGTCTCGTACGAGAGATTCATTCTCTCGCGCATTCAGA
AAGAAGGGTACCATCCCACTTTCCACCTACTTGAGGATTTTCAAAATT
GGAGATTATGTTGATATTAAGGTTAACGGCGCCATCCACAAAGGAATG
CCACACAAGTTCTACCATGGTCGCACTGGTCGTGTTTGGAATGTCACC
AAGCGCGCCGTTGGTGTCGAAGTCAACAAGCAGGTTCGTAACAAAATC
TTAAGAAAGAGGATCCATGTGAGGATTGAGCATGTTCAGCTTTCACGA
TGCACTGAAGAAGTCAAAGAAAGGATGAAGAAGAACGATCAACTAAAG
GCCGAGGCAAAAGCTAGAGGAGAAGTCATCAGCACAAAAAGGCAACCC
GTGGGACCCAAACCAGGTTTCATGGTTGAAGGTGCTACGTTGGAGACA
GTTACTCCCATACCATATGATGTGGTCAATGATTTGAAGGGAGGTTAT
TGATCTTAGTCTGTTTCGGAGGtGG*TGTTTGTTCTATCTGCTTTTCT
GAAACTGAAAGACAGGATTATAGTTtg*ttGGTGTCACCTGCAGATTT
CGCttgttagTttaaattTt

SEQ ID NO:534 45820      1110839_301539_1
GGTCTTAGTAGCAGCAGGGAAAAGGGGAAGGGAAAGGGGAAGGGAAGG
GAAAGATGCCGGCAGGACATGGGCTAAGGGCTCGAACTCGGGATCTGT
TCTCCCGGCCCTTCCGCAAGAAGGGGTACATCTCGCTGACGACGTACC
TGCGGAACTACAAGATAGGGGACTACGTGGACCTGAAGGTGAACGGGG
CAGTGCACAAGGGCATGCCCCACAAGTTCTACCACGGTCGGACCGGTG
TCATCTGGAACGTCACCAAGAGAGCCGTCGGTGTTGACATCAACAAGC
AGGTAAACACCAGGATTATCAAGAAAGGATTCATGTGCGAATTGAGC
ACATTCATCCATCACGCTGCAGGGAAGATTTCATTGCGCGGAGGAATA
AGAACGAGGAGCTTAAAACTGAAGCCAAAGCTCGAGGTGAAAAGATAG
CCCCAAGGCGGCAGCCTGCGGGTCCTAAACCTGCATCCATAGTAGAAG
GTGCTACTCTAGAGACAGTTACTCCGATTCCTTATGATGTGGTTAATG
ATCAGAAGGGAG

SEQ ID NO:535 45820      55577_300128_1
ctagggttttagttgtcgcacgaggtggaaaaatgcctgcgggtcatg
gagttcgggcgagaacgagggatctgttcgcgAGGCCATTcacgAAGA
AGGGTTACATTCCACTCTCGACTTACCTGAGAACCTTCAAGGTCGGcg
ATTACGtcgaTGTGTGTGAATGGTGCGATCCACAAGGGTATGCCTCAC
AAGTTCTACCACGGTCGTACTGGTCGTATCTGGAACGTCACTAAACGC
GCCGTCGGTGTTGAAGTCAACAAACAGATTGGCAACAGGATCATAAGG
AAGAGGATTCATGTGCGTGTGGAGCATGTGCAGCAATCAAGATGTGCT
GAGGAGTTCAAGCTGAGGAAGAAGAAGAATGATGAGCTCAAGGctgca
GCCAAAGCCAATGGTGAGACCATCAGCACCAAGAGACAGCCTAAAGGA
CCCAAACCAGGATTCATGGTCGAAGGAATGACCTTGGAGACTGTCACT
CCAATCCCCTACGATGTCGTCAACGATCTCAAAGGAGGCTATTAGTTC
TATCTTCTTGTGCTTTAGAACTCttttcatatgttttgtagcagact
taaaactaagaattatgatttactatataacaggagtttgcaatccca
aaaaaaa

SEQ ID NO:536 45820      35577_300077_1
acAAGAgAtctGTtcgGCGAGACCATTCAGGAAGAAGGGTTATATTCCA
CTCTCCACTTACCTCAGAACCTTCAAGGTCGGCGATTACGTCGATGTCA
AGGTTAATGGAGCTATCCACAAGGGTATGCCTCATAAGTTCTACCATGG
TCGTACTGGTCGCATCTGGAATGTCACTAAACGTGCCGTTGGTGTTGAA
GTCAACAAACAGATTGGGAACAGAATCATAAGGAAGAGGATACATGTGC
GTGTGGAGCATGTGCAACAGTCAAGGTGTGCTGAGGAGTTTAAACTCAG
AAAGAAACAGAACGATGTGCTTAAGGCTGATGCTAAAGCCAGAGGTGAG
ACTATCAGCACCAAGAGACAGCCTAAAGGTCCTAAACCGGGTTTCATGG

FIGURE 9hhh

```
TTGAAGGTATGACATTGGAGACTGTCACTCCCATTCCTTACGATGTTGT
CAACGATCTCAAGGGTGGTTATTGAGTTGTTTCCATTTTATTATCATTC
TCTACTCAGAATTTTTGCACTTGCTTTTTAATGATGTTTTTGTATCAA
ACAAGAGTGAATTCTATATGGTATGAGTTCATATTTTGTTAGGAAAGAT
GGTTTATCCCAATCAAAAAAAA
```

SEQ ID NO:537 45820      257805_301686_1
```
gcatcgatctcgtcgagaagaagcgcattCCACGATGCCGGCGGGTCAT
GGGCAGAGGTCGCGGACGAGGGATCTGTTCGCCAGGGCCTTCCGGAAGA
AGGGCCCGATCGCGCTTACCACATACCTGCGCACATTCCGGATCGGCGA
CTACGTGGATGTCAAGGTGAACGGCGCCATCCACAAGGGCATGCCGCAC
AAGTTCTACCACGGCCGGACTGGAGTCGTGTGGAATGTCACCAAGCGCG
CGATCGGCGTCGAGATGAACAAGCAGGTGGGGAACAGGATCATCAAGAA
GCGGCTCCATGTCCGCATTGAGCACGTAAAGCCATCGCGCTGCCGTGAG
GATTTCCTGAAGCGGGTCAAGAGCAACGCAGAGGCCAAGAGGAGTGGCG
TCAAGACTGCGCTCAAGAGGCAGCCCGAGGGACCAAAGCCCGGCTTCAT
CGTCGAGGGCGCGACACTGGAAACTGTGACCCCCGTCCCCTACGATGTT
GTCAACGATCTCAAGGGCGGGTACTGAGCGCCAGTTCTCGTTATTGTGC
tTtccATTTCATGTAATACAAGTTTTGGtTgctT
```

SEQ ID NO:538 45820      224003_300978_1
```
GCAGAACCCGATACATGTTCTCTCGGGACTTCAAGAAGAACGGAACTAT
CCCCATGTCCGTCTACTTGAAGACCTACAAGGTTGGAGACATTGTTGAC
ATCCGAGCCAACGGTTCCATCCAGAAGGGTATGCCCCACAAGTTCTACC
ACGGCCGAACTGGAATCGTCTACAACGTGACCAAGTCCGCTGTTGGCGT
CATCATCAACAAGGTTGTTGGCAACCGATTCATGGAGAAGCGAATCAAC
CTCCGAATCGAGCACATCAAGCACTCCAAGTGCCGACAGGAGTTCCTTG
ACCGAGTCAAGGCCAACGATCTCAAGCGAAAGGAGGCCAAGGCCAAGAA
CGAGATTGTCCAGCTCCGACGACAGCCCGGCGCCACCCGAGAGGCCAAG
ACCCTTGCCATCGACGAGACCAACTACCCTCTCACCGTTGCTCCTCTTG
CTTACGAGACTTTCATCTAAGCGGTCGAGAGTGACATAATAAAATTGTA
TCTTATTAAAAAAAAAAG
```

SEQ ID NO:539 45820      221186_300942_1
```
CGACGGCAATCAGGCGCGATGGGTCACTCTTACGGAAAGCGAGCGGGCA
CCCGATATGCCTTCAGCAGGGACTTCCGCCAAAAGGGCATGATCGCCCT
GAACACCTACCTGAAGGTGTACCACGTCGGTGACATTGTCGACATCAAG
GCCAACGGTGCTGTCCAGAAGGGTATGCCCTACAAGGTCTACCACGGCA
AGACTGGCGTTATCTACAACGTCACCAAGAGCGCCGTCGGCATCATCAT
CTACAAGAAGGTCAAGCACCGCTACATCGAGAAGCGCATCAACGTCCGA
ATCGAGCACATCCAGCCCTCTCGATCCCGTGAGGACTTCATCAAGCGAG
TCAAGGCGAAC
```

SEQ ID NO:540 45820      187293_300675_1
```
tctaccgaCGCCGCCGCCACCACCGCCACCGCCGCAGCAGAAGCAGCGCA
GCCGCAGGAGGGAAGATGCCGGCGGGGCACGGGCTGCGGGCGCGGACGCG
CGACCTCTTCGCGCGGCCGTTCCGCAAGAAGGGTTACATCCCGCTCACCA
CCTACCTGAGGACGTACAAGATCGGCGATTACGTCGACGTCAAGGTGAAC
GGCGCCGTGCACAAGGGCAT*GCCGCACAAGTTCTACCACGGCCGCACCG
GCCGCGTCTGGAACGTCACCAAGCGCGCCATCGGCGTCGAGATCAACAAG
CAGGTCGGTAACCGCATCATCAGGAAGAGGATCCATGTCCGTGTGGAGCA
TGTCCAGCCATCCAGGTGCACCGAGGAGCTCCGCCTGAGGAAAATCAAGA
```

FIGURE 9iii

ACGATCAGCTCAAGGCTGATGCCAAGGCCCGTGGTGAGGTTATCAGCACC
AAGAGACAGCCCGAGGGACCCAAACCTGGTTTCATGGTTGAGGGTGCTAC
GCTGGAGACTGTTACCCCCATTCCGTATGATGTGGTCAATGATCTCAAGG
GTGGTTACtagaATgCtTGTTTCTTGAACTggAGaaTccAATtAGCGTCt
a SEQ ID NO:541   45820        158601_200048_1
cgCTCTTCACAGAAAACACACGCAGAGCACTTCGCAGAGGAAAATGCCGG
CCGGCCATGGATTAAGGTCTCGGACGAGGGATTCATTCTCTCGCGCCTTC
AGAAAGAAGGGAGTAATCCCTCTTTCCACCTACCTCAGGATCTTCAAAGT
CGGTGATTATGTTGATGTCAAAGTGAACGGCGCCGTTCACAAGGGCATGC
CCCACAAGTTCTACCATGGCCGTACTGGACGCGTCTGGAACGTCACCAAG
CGCGCTGTTGGTGTCGAAGTCAACAAACAGGTTCGTAACAAAATCCTCCG
AAAGAGGATCCATGTGAGGATTGAGCATGTTCAACTTTCCGGTGCACCG
AAGAAGTCAAGGAAAGAATCAAGAAGAACGATCAGCTAAAGGCTGAGGCT
AAGACTAGGGGTGAGGTCATCAGCACAAAGAGGCAACCTCAAGGACCCAA
ACCAGGGTTCATGGTTGAAGGTGCTACTTTGGAAACTGTTACTCCCATAC
CATATGACGTGGTCAACGATTTGAAGGGAGGCTATTGATTTTACTTTGAT
TCTGAGCTTGTTTTTTTCTCCCTATGTGCTGTTATGACGTTGAGACTACT
AGTTATTCTCGGCATCAGTTGCAAAATTGCATTTTAGTTCCAAATTTTac SEQ ID NO:542   45820        1112376_301802_1
aagAGGGAAGAGGAGAAGGAGTAGTAGTAGGGGAGGGGAGTAGAAGAAGG
AAGGAAGGATGCCGGCAGGTCATGGACTTAGGGCTCGAACTCGGGATCTC
TTCTCCCGGCCCTTCCGCCGGAAGGGTTACA*TTTCACTGACGACGTACC
TCCGCAACTACAAGATCGGCGACTACGTGGACCTGAAGGTGAACGGTGCT
GTGCACAAGGGTATGCCCCATAAGTTCTACCATGGCCGTACCGGTGTCAT
CTGGAACGTCACCAAGAGGGCTGTCGGTGTTGAGATCAACAAGCAGGTCA
ACACTAGGATCGTGAAGAAGAGGATTCATGTGCGGATTGAGCACATCCAC
CCATCACGATGCAGGGAAGACTTCATTGCAAGGAGGAAGAAGAATGAGGA
ACTAAAGACAGAAGCTAAGAAGAAAGGAGAGAAGATAGCACCTAGGAGGC
AGCCGGAGGGGCCAAAACCGGGATTCATTGTTGAAGGTGCTACCCTAGAG
ACTGTTACACCTATTCCATATGATGTCGTCAATGACCAGAAGGGAGGGTA
CTAGAACTAGAGCTGCCTTCTTGTCTCATTTCTTAAATAGAGAACTACTC
CGGCATAATAGGATGGTTGCCACTCTCTGTCTAGTCACTTACTGGCttTT
GAACCTTAGCggc SEQ ID NO:543   45837        252962_301610_1
TCCTGTCTCTCTCATCTTCATCTTCATCTTCATGTTCTTCAATGGCCAAG
AGTGGGTCCCATTTCTTCACTGGCCAGGCTTCTCCATCTCTCCTCAGGCT
ATCATGCAAGCCGGTAATTGCGCCTGTGTCTAGGTGCCGAGTAATTTGTG
CAGTCACCCCCAAGAAGGTTGATTCTGCAGTAAAGAGAGTTCGCCAAGCA
GTAAAGAAACGCCTCAACAATAAGTCTCGCAAGTCAGAAATATTCACACG
CATGAAGAAGGTGTTTGCTGCAATAGATGGTTTGAAAAAGCAAAGTGAGG
CTTCTCCTGATGATATTCTACCGGTTGAGAAACTCATTGCGGAAGCGTAT
TCGGTCATTGACAAAGCAGCCAAGGTTGGAACAATCCATCGCAACACAGC
GGCACGGAGGAAGTCTCGGCTTGCACGGGCGAAGAAAGCAGCCTCTTTGC
AGCTTGGCTTTTATACACCAACGGCAGCGTGAATGACCTTAAATATAGAT
AACAATTCAACAAGAACTGTTATTCAATCAAATCGGTTTTATCCTTGATT
TTAGTATTACCATGTCTGATGTAAAGTGGCAAATACTTTTCCTTCAGTTT
ATNGTGAGTTCAAGAAATTAGAAAATGTGACAGTTTAT FIGURE 9jjj

SEQ ID NO:544   45837        39009_300075_1
aatcgaagagtctgaaagcgactaaatgtacattataaagaaacagattt
tgattttgaaagatctgggaacaaaaacaaATTTCcgtTATCCCCATGTT
CTTATgcagccAtgggcACAaCTTCTGATGGTGctgcagcaacTGcgtCT
GGGACGTACCAACCATGGTGAATTTCAACGGCTTTTTTCCTCCTagccaA
tcgagACTTCCTAcgggCACCattGTctTGTgtaatgctTTAACcttaa
ctGCTTTGTCAATTGCagaAtAagcCTCTCCTATCagtTTCTCCACCGTC
ACAATCTCAtcatctTGCGCATCactttTCTTCTTGAAcCCCTCAAGTGC
TtcaaGACCTTCTTCATCCGGGTACGgCTTCagaTTTCTTAGATTTGt
tgaaaAcacgcCTCTTCTCaGCTTGGCGAGCTCTCTTTGCAGCTGAATCA
GCTTTCTTGGTAGGAGCAGCAGCCTCACACACAATCAATTGCCTCATTGG
CTTCTGTACCCACAAATTCCCGGTTGAGAAGGCGACGCATTGAGAAACGC
TCTGAGAGAAGCTAAGGGAAGAGGATAAGGTAGCCGAAGCACCACGACGA
TTGGAGAAggaagaagatggtgacgaacaagagattcccttaagcgaaag
gactttgaattgggattcgagggtcgcacaggaagaaa

SEQ ID NO:545   45853        155235_301354_1
aaagcaagtaagggccgccattaggatTTTGGTAGAACCCTAACAAAAAT
AGTAAGGTCCTAAGTAACAGGGGACATGGATATGCAAAGCGAGTTCGATC
GCCTCCTCTTCTTCGAGCACGCTCGTAAGACTGCCGAAACTACCTACGCT
CAGAATCCCCTGGATGCTGATAACTTGACGAGATGGGGAGGTGCGTTATT
GGAATTATCACAGTTCCAGCCCGTTCCTGAATCAAAACAGATGATTTCTG
AGGCAACCTCGAAGTTGGAGGAGGCATTGGAGGTTAATCCTGAAAAGCAT
GAAACTCTTTGGTGTTTGGGGAATGCACATACATCTCATGCGTTTTTAAC
TCCTGATATGGAAGAGGCTAAGGTTTACTTTGACAAAGCAACTCAGTGCT
TTCAGCAGGCAGTTGATGCGGATCCAGGAAATGACATTTACTGCAAGTCT
TTGGAAGTTACCTCTAaGgctCCAGAGTTGCACATGGAAATCCACAAACA
GGGTTCCATGCCACAAGCTATGGGACCAGAGCCATCAACATCGACAaGCA
CAAAgagttcaaAAAAGaagaagagcaGTGatctcAAGTATGACattttt
GgatgggTAatacttgcagTTGGTa

SEQ ID NO:546   45853        193927_300777_1
CCCCCCGGTCCTCCGTCCTCCTCTCTCTCCCAAATCGGACATCGAGAGA
GAGAGAGAGAGAGGTCTAAAACCCTAACCCCCGAATCGAATCTCGTCGGA
AGCCGCCGCCGCCGGCGCCGCCGACGACGACGCCCGCGACGCCATGGACA
TGGGAGCGATGAGCGATCCTGAGAGGATGTGCTTCTTCGACCTGGCATGC
CAGAACGCCAAGGTCACCTACGAACAGAACCCGCACGAGGCCGACAATCT
CACGCGGTGGGGAGGCGCGCTGCTCGAGCTCTCGCAGATGCGGAACGGCC
CCGAGAGCCTCAAGTGCCTAGAAGATGCGGAATCCAAGCTGGAGGAAGCA
CTGAAAATTGATCCCATGAAGGCGGATGCGCTTTGGTGCTTGGGAAATGC
ACAGACCTCTCATGGATTCTTCACTTCAGACACTGTCAAGGCCAATGAAT
TCTTTGAAAAGGCAACCCAGTGTTTCCACAAGGCTGTTGATGTGGAACCT
GCGAATGA

SEQ ID NO:547   45853        231249_301082_1
AGGGACTACATGGAGCGGCTCATTTTCGTCGAGGCGACGAGGGAGAAGGC
CGCCGAGAGCTACGGGCGGTCTCCGGAGGACGCCGATTATCTGACGCGAT
GGGGCGGGGCACTGCTCCATCTATCGCATTTTCGCCAGGGACAAGACCAA
CTTAACATGATCGAAGACTCCGAGTCTAAGCTCCGGGAGGCCCTCTCGAT
CAATCCCAAGAAGCACGAGACGCACTGGTGCTTGGGCAATGCTTACACCG
CCCATGGTTTCTTGCTGCCGGAGACTGGCAAGGCCAACGAGTACTTCAAA
AAGGCCACAGATTGCTTCAAGAGAGCAGTGGACGAGGATTCCGACAATGG
CCTCTACATGAAATCACTGGAAATGGCCGCAAAGGGGCCTCCTGTGTACT

FIGURE 9kkk

TAGAGTTGCAAAAGCAGATGCTCACCCAGCAACTCGGCCTCGGCGGCAGC
AGCAGTGGCATCGGCAGCGGCGGCGGTGGCGGACACCTCTCCGGGAAGGC
AAAGAATAAGAAGCCAAACAGCGACTTCAAGTACGACGTTCTTGGCTGGG
CGGTGCTCGTTCTGGGAGTCTTCGCGTGGCTCGGGATGGCAAAGA

SEQ ID NO:548 45853        39423_300196_1
CCCACGCGTCCGATAGCGTCTCTGATGCCTAGCACATGATTCAGGAGGCCA
TCACAAAGTTTGAAGAGGCATTGTTGATTGACCCAAACAAAGATGAAGCGG
TTTGGAGTATTGGGAATGCATACACTTCATTTGCGCTTCTGACTCCTGACG
AGACTGAAGCTAAACA

SEQ ID NO:549 45855        1113146_301795_1
GAGAGAGAGAGAGAGAGAGCCATTGTCGCTGCCATGTCTAACCGCGAAGGA
GAGAGAGTCAGGTTGTACGTCCGAGGAAGCATACTTGGCTACAAAAGGGCC
AAGTCAAACCAGTATCCCAGCACTTCACTGGTTCAGGTTGAAGGTGTGAAC
ACCACTGAAGAAGCCAATTGGTACTTGGGGAAGAGGGTTGCCTATGTTTAC
AAAGCAAGAACCAAAAAGAATGGAACCCTCTACCGCTGTATTTGGGGAAGA
GTGAATAGACCCCATGGTAATAGTGGAGTGGTTCGAGCCAAGTTCACCAGT
AACTTGCCCCCCTGCTCCTTGGGTGCAAAAGTACGAGTATTCATGTACCCG
AGCCGCATTTGAGGAGCAGTGAAGCCAGGTTCCACAGGCTTCGGCTGGGCT
TTTTTGATTTGTGCTAGATTCATTTCGCATTGCGTTTGGACAATGCGGGTC
GGCTCTCTTACTTTCTATGCCTAAAAACAATATGTTCCGTTCACTTAACTA
TATGATGAGTCCTTAGGTTGAAAGGAATACTGCTGCTTTCTGCCTAGTTTG
TCATCTATCTTGGAACATTATGACTTCGGAATACATGCCATTTAGGTTTTT
TTCCCCTTC

SEQ ID NO:550 45855        130461_300487_1
GAATTCAAAGGCGATTTTCTTCATTTACAGCAAAGATGGTGAAAGGTCGTG
AAGGTGAACGTATCAGACTCTACGTCAGAGGAACCATTCTTGGATACAAGA
GGTCAAAGTCGAACCAGTACCCAAACACATCGTTGGTTCAGATTGAAGGAG
TGAACACCAAAGAAGAAGTACAATGGTATGCTGGTAAGAGGGTGGCTTACA
TCTACAAGGCTAAGGTCAAGACTAATGGTTCTCACTACCGATGCATTTGGG
GAAAAGTTATCAGGCCTCACGGTAACAGTGGTGTTGTTCGTGCTAAATTCA
CCTCCAACTTGCCACCTAAATCCATGGGAATGAGAGTTAGAGTTTTCATGT
ACCCAAGCAACATCTAAGGTTGAAGATTACTACTTGTGGTGGTGAAGTTCT
ACATTGCGAGCTTTAGTGTTCCGATATTGGTAGTATTCAGTTTAAGTTTTC
TTATTTAGAACTATCTTTTGTAGTTGGTAAACAAATTGGAAGTTACTTTAA
GTTTGAAAAGAAAGCTTTTGTGTCGGTGCTTTCAGATTAATTTTAAATGCT
ATTATACTTTTCAGTC

SEQ ID NO:551 45855        211674_300901_2
ATCAGTTCGACATCACGACAAACGACGAGCACCAGACCTCCTTGTATATCG
GTTACTTGAGAGGGCGGAAGCTACACAACAGACACGATGCCTTCCGAAAGT
GGTCACAGATTATACGTCAAGGGACGTCACCTGAGCTACCAGCGCTCTCGT
AACATCACCCACCCTGGCACCAGCCTGATCAAGATCGAGGGTGTTGACAGC
ACAAACGCTGCCAACTTCTACCTCGGCAAGAAGGTCGCCTTCGTCTACCGT
GGCCAGA*AGGAGATCCGCGGCACCAAGATCCGCGTGATCTGGGGCAAGGT
TACCCGACCTCACGGTAACTCTGGCGTTGTCCGCGCCAAGTTCGCCAAGCC
TCTTCCCTCAAAGTCTTTCGGTGCTTCCGTTCGCGTCATGCTGTACCCCTC
GTCGATATAAATAGGATTTCGGATTGGAGTTGGTAG*TGAGGGCGGTTCTC
ATTTGGTTGCATTGGTCGAGGCAAGGATAAAGCATATTGCCTTGCTTTGAG
GCTTATAACTAAAAAGACGTCAAATTCCCAACTTCGAAAGGTTCTTGGGCA
TCTGTGACTCGACGTATGTGGCAGAAATTTTTGCGAACCGCAAAAATGGAG
ACTcGAATCGAAacgaaCTGAGGCtGTgGCAgaccaaTTCTtcttccttCT
TCTTTTTtCCCCCTCCaa

FIGURE 9111

SEQ ID NO:552 45855      193753_300742_1
CCCCGCTTCCCCTCTTGGCCGCGCCTCCGAAAGCCCCACCGGCGGGGAGCTC
CCAGTCTCTCTCCGGCGGCAGAAGCGGCGGGGACTACCAGATGGTGAAGGGA
CGCACCGGGAAGGGCGTGGGGGTCTACGTCCGCGGGATCATCCTCGGATACA
AGAGGTCGAAGTCGAACCAGTACGAAAACACGTCGCTGGTGCAGATCGAGGG
GGTGAACACCAAGGAGGAGGTGGCGTGGTACTGCGGGAAGAGGATGGCGTAC
GTGTACAAGGCCAAGACCAAGAGCGGCGGTACGAACTACCGCGGTATCTGGG
GCAAGGTCACCCGCCCCCATGGCAACTCCGGGGTCGTCCGCGCCAAGTTCAA
GTCCAACCTGCCCCCCGGTTCCATGGGGCGCAAAGTCAGAGTCTTCATGTAC
CCGAGCAGGATCTAAAGACTCTTGAAGTGTGGAGGAT

SEQ ID NO:553 45855      8215_300304_1
CCCACGCGTCCGTAAAAGAGAGTAAGAAGAGGAAGACGAGAGTTACAAGGAT
TGAAAATGAAGGGACGTCAAGGAGAGAGAGTTAGATTGTATGTTCGTGGAAC
AGTCCTCGGCTACAAGAGGTCCAAGTCGAACCAATATCCCAACACTTCTCTC
ATCCAGATTGAAGGTGTGAACACTCAAGAGGAGGTCAATTGGTACAAGGGTA
AGCGTTTGGCTTACATCTACAAGGCAAAGACAAAGAAGAACGGTTCTCACTA
CCGTTGCATTTGGGGCAAAGTCACTAGGCCTCATGGTAACAGCGGTGTTGTC
CGTTCTAAGTTCACTTCAAACCTACCACCCAAGTCAATGGGAGCTAGAGTCA
GAGTCTTCATGTACCCTAGCAACATATGAGGAGGATAGATTTCAAGAAGTAT
CGGAAGGAATCGCCATTATCATTTCTCAGGAGCTGTAGTTTATCTATTCACT
TTTGTTCTAAACTCTCTGTTGGTTTTGATTTTATCTTTAGACGAAGTAAAAC
ATTTTTCTTCTTGAGATAATATTAATGGAACTTCAGAA

SEQ ID NO:554 45855      38480_300202_1
CCCACGCGTCCGGTCAAGGGACGCCAAGGAGAACGAGTCATACTCTACGTGAG
GGGAACCATCCTCGGATACAAAAGGTCGAAGTCCAACCAGTATCCAAACACGT
CCCTCGTCCAGATCGAAGGAGTTAACACTCAGGAGGAGGTAAACTGGTACAAG
GGAAAGAGGATGGCTTACATCTACAAGGCTAAGACAAAGAAGAACGGTAGCCA
CTACCGCTGTATCTGGGGAAAGGTTACCAGGCCTCACGGTAACAGCGGTGTTG
TCCGTGCCAAATTCACATCCAACCTTCCTCCCAAGTCCATGGGAAGCAGAGTG
AGAGTCTTCATGTAT

SEQ ID NO:555 45855      255238_301647_1
ggggtcgaGGGAAGGAGTAGGAGGGAGGGAGTCGAAGGTAGGAGCCATACCTG
TACCTGCACCATGTCGGCCACCCAAGGAGAGCGCGTCAGGTTGTATGTCCGAG
GGAGCATCCTTGGCTACAAAAGGGCTAAATCAAACCAGTACCCCAACATGTCG
CTAATTCAAATCGAAGGTGTCAATACAACTGAAGAAGCAAATTGGTATTTCGG
TAAGAGAATTGCATATGTATACAAAGCTAGAACAAAGAAGAATGGCACCCTAT
ATCGCTGCACTTGGGGAAGAGTGACCCGGTCCCATGGTAACAGTGGAGTTGTT
CGAGCCAAGTTCAAAACGAATTTGCCCCCCTTGTTCACTGGGCGGAAAAGTGC
GAGTATTTATGTACCCCAGCAAAATTAAGTTTATCTGGTATCATTGttAGGA
GAACTAGTTAATGAGGTATTAAGTTTACTGGAAGAGTAGTGGTATCTTGTAGG
CATGGATTCTCTTTCTTTTTATTGAGTTATATTACATTTGCTGATTTTCCTCC
CTCTCAATGGTTTAAGGATtgAtTGTTActtgtttaggttgtcggcaTCATCC
atgcttGAACATTGCTGAAGAATCATAGgCtttatttta gaTGGTTTTTAAAA
CCAGttCCCCTA

SEQ ID NO:556 45855      223916_300977_1
AACTCTACTCGACTCTACGTTAAGGGAAAGCATATCTCTTACCAGCGAAGCAA
ACGAGTTGTGAACCCCAACGTTTCTCTCGTCAAGATTGAGGGCGTCTCCAACC
CCGACGAGGCCAAGTTCTACGTCGGAAAGCGAGTTGCTTACGTCTACCGAGCC
GAGAAGGAGATCCGAGGCTCCAAGGTCCGAGTCATGTGGGGCAAGATTTCCCG

FIGURE 9mmm

AACCCACGGTAACTCCGGTGTGGTCCGAGCTCGATTCCGACACAACCTCCCCG
CCAAGACCTTTGGCTCCTCCGTCCGAATCATGCTCTACCCTTCCAACATCTAA
GTGGTGTCGAGAGGTCTGAGTATTCAAAATAACCGTTTCTCCAACGGTCGCGC
GTATAGTGTATTATAGGAGAATGAACATGTGCAATAGCAAAA

SEQ ID NO:557  45855   223853_300976_1
ACCAGACTCTACGTTAAGGGAAAGCACCTGTCTTACCAGCGAAGCAAGCGTGT
TGTTAACCCCAACGTGTCTCTCGTCAAGATTGAGGGTGTCTCCAACCCCGAGG
AGGCCAAGTTCTACCTCNGGAAAGCGAGTGGCTTACGTCTACCGAGCCGACAA
GGAGATTCGAGGCACCAAGGTCCGAGTCATCTGGGGCAATATCGTCCGAACTC
ACGGTAACTCTGGCGCCGTCCGAGCCCGATTCCGACACAACCTGCCTGCCAAG
ACCTTCGGCTCTTCTCTCCGAATCATGCTCTACCCTTCTAACATCTAAGCGAA
GATAGGTATGAGTTATTGAGGATTGGGCAACGCAAAAAAGGAAAACATGATG
GAAAAACAAAAGAAAATGTCAATGATGACTCCCGTGCATCTTGTATAAAGCAA
TTAATTTATTGGCGAATGTG

SEQ ID NO:558  45855   156450_301366_1
GACCACGCGTCGCCCATCCCTATACCTTGAATCGAAAATGGTGAAAGGACGTC
AAGGAGAGCGCATCAGACTCTATGTCAGAGGAACCGTTCTTGGATACAAAAGG
TCGAAATCGAACCAGTACCCAAGCACTTCGTTGATTCAGATTGAGGGAGTGAA
CACTAAGGAGGAAGTGGATTGGTACCTCGGGAAGCGCATGGCGTACATCTACA
AGGCTAAGACAAAGAAGAATAACTCTCATTATCGCTGCATTTGGGGTAAGGTTT
GTAGGCCTCATGGAAACAGCGGCGTTGTCAGAGCTAAGTTCAAGTCCAACTTGC
CGCCTAAGTCTATGGGATCTAAGGTCAGGGTTTTCATGTACCCAAGCAATATAT
AAGTGAGGGCATCACGGAGTAGATGATAAGATCAAGGTCATTCGATGCTTTGGA
AGGCTTTATGCCTGATCAAGGATGTCTGATGATTGATCTTCATTTTTACTAGTT
AAGAATTAAATTGTGGCTTTTGCTTAGTGGAGTTACATTGTTGGTGTTTTGTTT
ATCACTTCTGAGTAATACTGAAGATCCAAATCTAATTAGATGTGGCTAGTTTTA
CTC

SEQ ID NO:559  45864   284436_200098_1
GTGGACTTGGAGCTCGCAAACTTACTAAAAGCCAAGTGAAAGTCTCTATGAGC
AGAAGCCTGAAGAACCGCCTATTCAAATTTCCTCCTCCAGCACTGCAAGTAATG
CAACAACTGTTGGTTCATCATTCACATCTCGTTTTGAGTACACAGACAATATCC
AACCTGCTGAGACGAGTTTTGGAGGCCCTCGTGTTCTTAACCATGTAGCCCCTC
CGAAGTCCTCCAACTTTTTTGCAGATTATGAAACGGATAATGGTTTCACAAAGA
AGACAAATTCCAATTCTTCAAAAATTCAAAAATTGGTGAAGCCGCTTGAAGTTT
GTTTTGATCCTGTTTCGAGTGTCCTGGATTGTCAACAAGCAAGAGTCAGTTCTA
TTGGAGCTTTGGATTCTTCTGTAGCTATTATTTCATTGATGAAATTCCCCATGC
GTTCTGGAATTGAGGAAACTGATGAAGCAAGGAAGAAGTTTTCTAATGCCAAAT
CCATTTCATCTGCTCAATACTTTGGTGATCAGTCTAAAACTGAAATGGAAGCCT
CAGTCTCTACAGAAATTCTCGGGTTCAAGTGCAATCTCTAGCGCTGACCTAT
TTGGT

SEQ ID NO:560  45866   1119355_301896_1
TCTTTCTCCTCTCTCTCCCTCTCCCAGGCTCAGGGGAGGACATAGCAAAGGAGA
AGAAGGTCTTTTCTCTTGGATATACGCCATCATGTTGGTGTACAGAGATCTCAT
ATCAGGTGATGAGCTACTTTCAGACTCTTTTCCC*TACACTGAAATCCAGAATG
GCATAATATGGGAAGTGGAAGGAAAGTGGGTTGTCCCTGGAGCACTCAGTGTTG
ACATTGGGGCCAACCCTTCAGCTGAGGGTGCTGATGAAGATGAGGGGGTTGATG
ACACTGTGCAGAAAGTTGTTGACATTGTGGACACATTTAGGTTGCAGGAGCAAC
CCTCAATGGACAAGAAGGCATTCATTTCTTATGTGAAACGCTTCATTAAAAATT
TGACCCC*AAAGGTACTTCCTGATCGCCAGGAAGAGTTCAAGAAGAATGTGGAG
GGAGCTGTGAAATGGCTTATGCCAAAGCTGAGTGACTTGCAATTCTTTGTTGGTG
AGAGCATGGCTGATGACAGTGCGATCGTTTTGCCTACTACAAGGAAGGGAAGGC

FIGURE 9nnn

CGACCCAACATTCCTTTATTTCCGTGATTCCCTGAAGGAAGAGAAGTGCTGAGCT
CACTTGCGGCCATTTTTTGAACAGAATGTTTGcaaaGGAtttaTATAGGTtATGA
AAGATGCTTATGCTGTTTggcatcttaggACTcagatgttTTTTGCGttgcaCTT
GagaacATCTAAAttgccttgggcaattgTGaaTGttaataacCttGCta

SEQ ID NO:561  45866      128853_300478_1
TTTTCTCCTCCTCTTGTGCGTTTTTGTTAAGCGCAAGTTCTTCAGAGGGAGAAAC
AGAGAAAAATTCTCTCCGATAATGTTGGTTTATCAGGATCTTCTCTCCGGTGATG
AGCTCCTTTCGGATTCATTTCCCTACACTGAACTTGAAAATGGAGTGCTTTGGGA
AGTACAAGGGAAGTGGGTTGTTCAGGGAGCTGTTGATGTGAACATTGGGGCTAAT
CCATCTGCTGAAGGCGCAGATGAAGATGAAGGTGTTGACGATCAAGCCATCAAGG
TTGTCGATATTGTTGACACTTTCAGGCTTCAGGAGCAACCTTCTTTTGACAAGAA
GCAGTTTGTTGCCTACATGAAGAAATATATCAAGAACCTAACACCCAAGTTAGGC
GCAGAGCAGGAAGAAGTTTTTAAGAACAACATTCAAGGAGCAACCAAGTACCTTT
TGTCAAAGCTCAGTGACCTTCAATTCTTTGTTGGTGAGAGCATGGCTGATGATAC
TGGAATGGTGTTTGCCTACTACAAGGATGGCGCCACTGATCCAACCTTTTTGTAC
CTCGCACATGGACTCAAGGAGGTCAAGTGTTAAAAAGAGTAGGTACTTGACCTGT
TATGTGTTCTCGGTTTTGATGCAACTTTTACCATTAAATCAGTTGTCTGAAGTTA
AATTTTGTACTGCAAACTTATATAGCAGCTTCGATATTTGTGTGCTTTATATGGA
TTGATTGAAGAATCAACACATATACCTAAGATGGTAGCAAATTCTTTTTGATTTG
TTACTTTTGTGACTGTTGGACGTTCTTgttgtTATGTACTAGCAATTTTGCATT

SEQ ID NO:562  45866      234021_301096_1
gacaattctgtagATCCAGCGCGGTGCGATCCGGCCGCCATGCTCGTGTACCAGG
ATTTGCTGTCGGGCGACGAGCTCCTGTCGGATTCGTTCCCGTACAAGGAGATCCA
GAACGGCGCGCTGTGGGAAGTGGAAGGGAAATGGGTGGTGAAGGGATCCGTGGAC
GTGGACATCGGCGCCAATCCGTCGCAGGAGGGCGGCGAGGATGAGGAGGGCGTGG
ACGATCAGGCCGTCAAGGTGGTGGACATTGTCGATACCTTCCGCCTCCAGGAGCA
GGCGGCGTTCGACAAGAAGACTTTCCTGGCCGCCATGAAGAAGTTCATCAAGAAG
CTGTCGGAGGTTCTGCCCGAGGAGGAGCAGGCCGAGTTCAAGAAGAACATCGAGG
CGGCGGTCAAGTGGCTGCTCTCCAAGCTCAGCGATTTCCAGTTCTTCGTCGGGGA
GAGCATGAAGGATGATGCGACGCTCGTCTTTGCGTACTACAAGGAAGGCAGTTCC
GATCCCACCTTTATCTACTTCAAGCACGCGTTGAAGGAAGTCAAGTGCTAATAGT
ATTGTCGTTGTTTGTCCCTCTCAAGATCTAGTATGGttcTGTATGctgctgcaaC
TTCTCTGTCGttttaattcccTCTGTGATCaaTc

SEQ ID NO:563  45866      2768_300338_1
cTCCCGCAACCTTCGATTTTCGTTTATTCGCATCCATCGGAGAGAGAAAACAATC
AATAAGCGACCATGTTGGTGTACCAAGATCTTCTCACCGGTGATGAGCTTCTGTC
TGACTCTTTCCCTTACAAGGAGATTGAGAATGGAATCCTCTGGGAAGTAGAAGGAA
AGTGGGTTACTGTGGGAGCTGTAGATGTTAACATTGGTGCCAATCCATCTGCTGAA
GAAGGTGGTGAGGATGAAGGTGTTGATGACTCTACTCAAAAGGTTGTTGACATTGT
CGACACCTTCAGACTTCAGGAGCAACCAACTTATGACAAGAAGGGATTCATCGCTT
ACATTAAGAAATACATTAAGCTTTTGACACCCAAGCTCAGCGAAGAAGATCAAGCT
GTCTTCAAGAAGGGTATTGAGGGAGCTACCAAGTTTTTGCTCCCCAGGCTCAGTGA
CTTCCAATTCTTTGTTGGGAGGGTATGCATGATGACAGCACTTTGGTCTTTGCTT
ACTACAAGGAGGGTTCAACTAACCCAACATTTTTGTACTTCGCTCATGGTTTGAAG
GAGGTCaaGTGCTGAGAGAGaagcTcTCGTTgGGTTACtgtggtcggtCGCagcga
ctCTCTAaggttATGTTTCTTTATATt

SEQ ID NO:564  45866      188922_300611_1
cccccccccCGCTCTCTCTCCGTCCGTCCGCGCCGCTACTCCCCCCCTCGCCGAG
AGAGCTCTAGGGTTTCCGCTGCCGAATTTTTTTTTTAATTCGGGGGGAGAGATTT
GAAGAGGCGGCACCATGTTGGTCTACCAGGATCTGCTTACCGGTGACGAGCTCCT
GTCGGATTCGTTCCCCTACAGAGAGATCGAGAACGGCATCCTCTGGGAAGTCGAT FIGURE 9ooo

```
GGCAAGTGGGTCGTTCAAGGAGCTATTGATGTGGACATTGGTGCCAACCCATCTG
CTGAGGGTGGTGGTGATGATGAGGGTGTTGATGACCAAGCTGTGAAGGTGGTCGA
CATTGTGGACACCTTCCGTCTTCAGGAGCAACCTCCTTTTGACAAGAAGCAGTTT
GTGACCTTCATGAAGCGCTACATCAAGAACCTCTCCGCCAAGCTGGATGCGGAAA
AGCAAGAGGAATTCAAGAAGAACATTGAGGGTGCCACCAAGTACTTGCTTGGAAA
GCTCAAGGACCTTCAGTTCTTTGTTGGTGAGAGCATGCATGATGATGGCGGCTTG
GTGTTTGCCTACTACAAGGACGGAGCCACCGACCCAACCTTCCTTTACTTCTCTC
ATGGGCTGAAGGAGGTCAAGTGCGCGGCCGCTTATCCGTATGATGTTCCGGATTA
TGCCGAGCTCTACAAACAGCTGTTgaaTTTTGATTTGCTGAAGTTGGCGGGTGAC
GTGGAATCTAACCCTGGTCCTAGGTCTAGAaTGGCTACTTTCTcttgtgTGtgtt
gtGGTACCTTAACTACAAGTAcTtActgTGGTAAGAGATGTGAGCgaaagcaTGT
ATATTCTGAAACAAGAAATAAgagattggaaCTTtAcaagAAGTaTCt
```

SEQ ID NO:565  45866  159181_200140_1
```
agccttgctggtctcttcttgtcatcctcctactttttagagaGAGAAAGCAAA
AGAATACGCTACCACCATGTTGGTTTATCAGGATCTTATCTCCGGTGATGAGCT
CCTCTCAGATTCATTTCCCTACAAAGAACTTGAGAATGGATGTCTTTGGGAGGT
TCAAGGGAAGTGGGTTGTTCAAGGTGCTCTTGATGTAGACATTGGGGCGAATCC
TTCTGCCGAGGGTGCTGATGAAGATGAAGGTGTGGATGATCAAGCTGTCAAGGT
TGTCGATATTGTTGACACTTTCAGACTTCAGGAGCAACCATCTTTTGACAAGAA
ACAATTTGTTACATACATGAAGAGATACATCAAGAACCTGACTCCCAAGCTAGA
AGGAGAAGCCCAAGAAGCATTTAAAAAGAACATTGAATCAGCAACTAAGTTCCT
CATGTCAAAGCTCAAGGACCTTCAGTTCTTTGTTGGCGAGAGCATGCATGACGA
TGGTGCCCTGGTGTTTGCATACTACAAGGATGGTGCAACTGATCCTACCTTTTT
GTACCTTGCACCTGGCTTGAAGGAGGTCAAGTGCTAGATGTCTGTTTGGAGATT
TTGAGCTACAAGTTTCAAATTTGAGATgttccaTGTAGTTTTAAGTTTTTATCT
TTTTTTTgctTATTTATGGTAGTGTCTTATGaaCTTGgGTACTTGttttaacc
agTACtttcTgAACt
```

SEQ ID NO:566  45869  146922_200005_1
```
ggtttcaccACTTACCCACCTGCATATCTGAGCCCCCAAGCATCAGGCAAGAAT
CTACTTATTGGTACTAACTTCGCTTCTGCCGCTGCTGGCTATGATGATAAAACT
GCCATCCTCAGCCATGCAATTCCATTGTCAATACAGATGCAACATTATAAG*GA
ATACCAAGCCAAGCTAACAAAAGTTGCAGGCAGCCAAAAAGCTGCATCAATCCT
AAAGGATGCGCTCTACATATTAAGTGCAGGAAGCAGTGATTTCTTACAGAATTA
CTACATTAATCCTTATATTAACAAACTCTATACTCCTGATCAGTATGGTTCTTA
TCTTATCGGCATCTTCACTAGCTTTGTCAAGGATTTGCATGCCCAAGGAGCAAG
GAGAATTGGAGTGACTTCACTACCACCATTGGGCTGTCTTCCTGCTGCTAGAAC
ATTGTTCGGATTTCACGAGAGTGGATGTGTCTCAAAAATCAATACAGATGCCCA
ACAATTCAACAAAAGATAAATTCAGCTGCTACACAATTACAAAAACAACTCCC
AGGCCTTAAAATTGCCATATTTGACATTTTCCAGCCCCTATATGACCTCGTCAA
ATCTCCATCAAACCACGGATTCACGGAAGCAAATAAGGGGTGTTGTGGAACAGG
AACAGTGGAGACGACGTCGTTGTTGTGCAACCCAAAGTCACCAGGGACTTGTAG
CAATGCAACTCAATATGTGTTTTGGGATAGTGTACATCCATCTGAAGCTGCTAA
CCAAGTCCTAGCTGATTCACTCATCATCCAAGGCATCAACCTTATTGGATAATT
GAACAGAATTTAAAGTATTGTTACTCTTATATTTCTCGAATTTAATGTATAA
GTCTTTCTCAAAGTTACCACGTTCATTTCTTTTGTTTCTGGGGTTTCTTGTTT
CTGGGAGATGAAAACATTGTCCTGTATTGCTTAATATTTTCCTTTTATTAATGA
GAGTACCATGTGTTGTGTTGGaaacaaaatgtaataaggaagatttcaacc
```

SEQ ID NO:567  45869  27502_300390_1
```
cccacgcgtccgctctACATTTATCAAGCAAGTGTATGCGGTTGGAGCAAGGAA
GATCGGTGTGACATCTCTGCCTCCAACAGGATGTCTTCCCGCTGCAAGAACCCT
TTTCGGTTTCCATGAAAAGGCTGTGTTTCAAGACTCAACACAGATGCTCAAAA
CTTTAACAAGAAGCTTAACGCTGCTGCTTCAAAGCTTCAGAAGCAATATTCCGA
```

FIGURE 9ppp

TCTTAAGATTGTTGTCTTCGACATCTACTCTCCACTTTATGATCTTGTTCAGAA
CCCTTCCAAATCCGGATTCACGGAAGCAACCAAAGGATGTTGTGGAACAGGAAC
AGTCGAGACAACTTCACTCTTGTGCAACCCGAAATCGTTTGGGACATGCTCCAA
TGCTACTCAGTATGTGTTCTGGGACAGTGTGCATCCTTCTGAAGCTGCCAATGA
GATTCTTGCCACTGCCCTAATTGGACAGGGCTTTTCTCTCCTCGGTTGATCTCA
CGTATTTTTCTTATATTCTCTTTTCAAATCGCTGTTTCTATCACACATTGAGTC
ATACATTTGTTTTTCTTTGAATTATGTATCAAAGCATCACTGTTTTACTAAAAA
TGTATTGAAACTTATTACAAGTACTAAACCAAGAGTTGAGAAC

SEQ ID NO:568    45874         21693_300070_1
CTTCAATTCTCTCCCTTCTCTCTCTTCTCTTTCTTCTTCTTCCTCGCGCCT
TCTTCAATCTCCggcTTTCGCTTCTCCAGTTTTGAGCCTTAAACCCAACGCTGT
CGAGTCCAAGAACAGAGTCTCTCTCAGTGCTTACAGCTTGAACTCTAGCCATGG
AAGAATTGTGGTGAAGGCGGCTGCTTCTGGCGTGGACGGGGCTGAGCCTGAGAG
CAATGAGGAACCAAAGACTGTTGTTGCTGCTGTTCCAGTGGATAAACTACCGTT
GGAATCGAAAGAAGCTAAAGAGAAACTGCTCTTGGAATTGAGGCTGAAGATGAA
GCTGGCCAAAAAGATTAGGCTACGCAGGAAACGTCTGGTTCGTAAGCGTAAGAT
GAGGAAGAAGGGTCGATGGCCACCTTCCAAGATGAAGAAAAACAAGAATGTCTA
AGTGACTCAACTGTTTGCTGCTTTTCGTATTCGTTTTTTGTAATGTTCTTTTTG
GTGTTCAAAGACCATTAATGTACTTCAAATGCAACCATTGTTTTTGGATT SEQ ID NO:569    45874         21694_300069_1
GGCGAAAATCAATGGTTGCATTTGAAGAACATTAATGGACTTTAACCACCAAAA
AGAACATTACAAAAATCCAATACTAAACGCAGCATACAGATTAGTCACTCACAC
ATTCTTGTTCCATTTAATCTTGCAAGGCGGCCATCGACCCTTCTTCATCATCTT
ACGCTTACGAACCAGACGTTTCATGAGTAGCCTAATCTTTATGGCCAGACTTCA
TCTTCAGCCTCAATTCCAACATCAGCTTCTCTTTAACTTCTTTCAATTCCAACG
GTAGTTTATCCACTGGAACAGCACCAACAACAATCTTTGGTTACTCATTGCTCT
CAGGCTCAATCCCGTCCACGCCATAAACAGACGCCTTCACCACAATTCTTCCAT
GGTTACAGTTCAAGCTGTAATCACTGAAAAAACTCTGTTTTGGACTCTACAG
CGTTGGCTTTAAGGCTCAAAACTGG SEQ ID NO:570    56465         37186_300081_1
TTTAAAATATAAATAAAAGCCTAAAACATCATTTATTTAATCAACCAATAAAAA
TAATTTTGCATTGAAAATTTAAAACATCATTTATTTAAAAACCAAAATGAAAGC
TTTAAACATCATTTATAAAAAGATTGGAAGGAGTATATTTTTATTTGGACAAAG
AAGATAATGCTTATGGAATGTCTCTTACTTCAAATGCAAACCTCGGTAGTACCT
GTAAGATACTTTTTTAAATAAGTGACTTGGCTGCTTCAACCATAGCTTCAATGG
TGATACCAAACTCTTTATAAAGCTTTCCTGCTGGTGCACTTGCTCCAAACGTAT
CAATTCCAATCGATTTCCCTTTTCCTCCGACGATCTTTCCCCATCCAAAAGTCG
ATCCAGCTTCGATACTAACTCTAGCTGATACATCAGATGGCAAAACACTTTCCT
TGTATCGGACGCGTGGG SEQ ID NO:571    56465         47330_301726_1
GTTTCCTTGGTGGAAGTGCTGACCTTGCATCATCCAACATGACATTGCTGAAAGC
CTTGGCGACTTCCAAAAGGCCACACCTGAAGAAAGAAATCTTAGGTTTGGTGTTA
GGGAGCACGGAATGGGAGCCATCTGCAATGGCATTGCCCTTCACAGCCCCGGTCT
TATCCCTTACTGTGCGACGTTCTTTGTCTTCACCGACTACATGAGAGGTGCCATG
AGAATCTCAGCTTTGTCTGAAGCTGGTGTTATCTATGTTATGACCCATGATTCCA
TTGGTCTTGGAGAAGATGGACCAACCCATCAGCCCATTGAGCACATTGCAAGTTT
CCGTGCTATGCCCAACACTCTTATGTTCCGTCCTGCTGATGGAAATGAAACAGCC
GGTGCATACAAGATCGCTGTCACCAAGCGCAAGACACCATCTATCTTAGCTCTGT
CTaggCAAAAGCtgccTCATCTTCCAGGTACATCCATCGAAGgAGTggAAAAGGG
TGGATATACAATTTCTgacGACTCTTCaggcaaCAAACCCGATGTGATCTTGATT
GGAACTGGTtCTGagCTagagattgctgcaCaggctgcgGaggt

FIGURE 10-A

| A list of metabolite compounds present in altered levels relative to reference samples as characterized by gas and liquid chromatography and mass spectrometry. This list corresponds to samples transfected with nucleic acid sequence, Seq 105039, SEQ ID NO: 334 | | | |
|---|---|---|---|
| Compound CAS# | Compound Name | Modification | Compound Class |
| 6915-15-7 | Malic acid | 120% to 160% | Acids - Hydroxy Alpha |
| 71-00-1 (RT) | Histidine | NEW | Amino Acids and related Compounds |
| 61-90-5 (RT) | Leucine | NEW | Amino Acids and related Compounds |
| 63-68-3 (RT) | Methionine | 170% to 530% | Amino Acids and related Compounds |
| 147-85-3 (RT) | Proline | 30% to 220% | Amino Acids and related Compounds |
| 60-18-4 (RT) | Tyrosine | NEW | Amino Acids and related Compounds |
| 999999-99-9 | F3-U0.813 Carbohydrate | 160% to 200% | Carbohydrate |
| 999999-99-9 | F3-U0.846 Carbohydrate | 80% to 120% | Carbohydrate |
| 999999-99-9 | F3-U0.872 Hexose | 80% to 120% | Carbohydrate |
| 50-99-7 | Glucose | 100% to 200% | Carbohydrates |
| 57-48-7 | Fructose (chiral) | 100% to 160% | Carbohydrates |
| 13190-97-1 | Solanesol | NEW | Sterols, Oxygenated Terpenes and other Isoprenoids |
| 469-38-5 | Cycloartenol | NEW | Sterols, Oxygenated Terpenes and other Isoprenoids |
| 59-02-9 | alpha-Tocopherol | 160% to 200% | Sterols, Oxygenated Terpenes and other Isoprenoids |
| 7616-22-0 | gamma-Tocopherol | NEW | Sterols, Oxygenated Terpenes and other Isoprenoids |
| 999999-99-9 | F3-U0.736 | 60% to 90% | NA |
| 999999-99-9 | F3-U0.852 | NEW | NA |
| 999999-99-9 | F3-U0.858 | NEW | NA |

FIGURE 10-B

A list of metabolite compounds present in altered levels relative to reference samples as chararacterized by liquid chromatography. This list corresponds to samples transfected with nucleic acid sequence, Seq. 131193 and 182206, SEQ ID NO:280

| Compound CAS# | Compound Name | Modification | Compound Class |
|---|---|---|---|
| 56-40-6 (RT) | Glycine | NEW | Amino Acids and related Compounds |
| 56-41-7 (RT) | Alanine | 145% to 350% | Amino Acids and related Compounds |
| 56-45-1 (RT) | Serine | 65% to 135% | Amino Acids and related Compounds |
| 56-84-8 (RT) | Aspartic Acid | 25% to 90% | Amino Acids and related Compounds |
| 56-86-0 (RT) | Glutamic Acid | 35% to 120% | Amino Acids and related Compounds |
| 56-87-1 (RT) | Lysine | 5% to 355% | Amino Acids and related Compounds |
| 56-89-3 (RT) | Cysteine | NEW | Amino Acids and related Compounds |
| 60-18-4 (RT) | Tyrosine | NEW | Amino Acids and related Compounds |
| 61-90-5 (RT) | Leucine | NEW | Amino Acids and related Compounds |
| 63-91-2 (RT) | Phenylalanine | NEW | Amino Acids and related Compounds |
| 71-00-1 (RT) | Histidine | NEW | Amino Acids and related Compounds |
| 72-18-4 (RT) | Valine | 100% to 245% | Amino Acids and related Compounds |
| 72-19-5 (RT) | Threonine | 20% to 260% | Amino Acids and related Compounds |
| 74-79-3 (RT) | Arginine | 105% to 1225% | Amino Acids and related Compounds |

FIGURE 10-C

A list of metabolite compounds present in altered levels relative to reference samples as characterized by gas chromatography and mass spectrometry. This list corresponds to samples transfected with nucleic acid sequence, Seq. 170474, SEQ ID NO:335

| Compound CAS# | Compound Name | Modification | Compound Class |
|---|---|---|---|
| 999999-99-9 | Citric acid & Carbohydrate | 310% to 350% | Acid & Carbohydrate |
| 463-77-4 | Carbamic acid | 90% to 130% | Acids |
| 6000-40-4 | Glyceric acid | NEW | Acids |
| 7664-38-2 | Phosphoric acid | 60% to 100% | Acids |
| 10191-35-2 | Butanoic acid, 2,3,4-trihydroxy- | 260% to 300% | Acids - Hydroxy |
| 147-85-3 | L-Proline | 90% to 130% | Amino Acids and related Compounds |
| 999999-99-9 | F3-U0.813 Carbohydrate | 440% to 480% | Carbohydrate |
| 999999-99-9 | F3-U0.816 Carbohydrate | 150% to 340% | Carbohydrate |
| 999999-99-9 | F3-U0.846 Carbohydrate | 360.00% to 810% | Carbohydrate |
| 999999-99-9 | F3-U0.872 Hexose | 360% to 870% | Carbohydrate |
| 999999-99-9 | F3-U1.069 Carbohydrate | 240% to 280% | Carbohydrate |
| 999999-99-9 | F3-U1.233 Carbohydrate | NEW | Carbohydrate |
| 50-99-7 | Glucose | 100% to 1950% | Carbohydrates |
| 57-48-7 | Fructose (chiral) | 60% to 500% | Carbohydrates |
| 57-50-1 | Sucrose | 60% to 80% | Carbohydrates |
| 77-95-2 | Quinic acid | 80% to 500% | Phenols and Related Compounds |
| 999999-99-9 | F3-U0.736 | 150% to 210% | NA |
| 999999-99-9 | F3-U0.75 | NEW | NA |
| 999999-99-9 | F3-U0.767 | NQ | NA |
| 999999-99-9 | F3-U0.785 | 70% to 110% | NA |
| 999999-99-9 | F3-U0.843 | NEW | NA |
| 999999-99-9 | F3-U0.853 | NEW | NA |
| 999999-99-9 | F3-U0.882 | 110% to 150% | NA |
| 999999-99-9 | F3-U0.903 | 80% to 120% | NA |
| 999999-99-9 | F3-U1.229 | 60% to 100% | NA |
| 999999-99-9 | F3-U1.232 | -60% to -80% | NA |

FIGURE 10-D

A list of metabolite compounds present in altered levels relative to reference samples as chararacterized by gas and liquid chromatography. This list corresponds to samples transfected with nucleic acid sequence, Seq 175736 and 183116, SEQ ID NO:336

| Compound CAS# | Compound Name | Modification | Compound Class |
|---|---|---|---|
| 5561-99-9 | 11-Eicosenoic acid, (11Z)- | 160% to 200% | Acids |
| 112-80-1 | 9-Octadecenoic acid (9Z)- | 90% to 130% | Acids - Fatty |
| 112-85-6 | Docosanoic acid | 100% to 140% | Acids - Fatty |
| 506-30-9 | Eicosanoic acid | -60% to -80% | Acids - Fatty |
| 57-10-3 (RT) | Hexadecanoic acid | 5% to 11% | Acids - Fatty |
| 57-11-4 (RT) | Octadecanoic acid | 5% to 31% | Acids - Fatty |
| 2724-58-5 | 16-methyl-Heptadecanoic acid | 60% to 100% | Acids - Fatty Branched |
| 463-40-1 (RT) | 9,12,15-Octadecatrienoic acid | -3% to -11% | Acids - Fatty Unsat |
| 60-33-3 (RT) | 9,12-Octadecadienoic acid | 5% to 55% | Acids - Fatty Unsat |
| 56-40-6 (RT) | Glycine | NEW | Amino Acids and related Compounds |
| 56-45-1 (RT) | Serine | 25% to 155% | Amino Acids and related Compounds |
| 56-84-8 (RT) | Aspartic Acid | 25% to 90% | Amino Acids and related Compounds |
| 56-86-0 (RT) | Glutamic Acid | 35% to 110% | Amino Acids and related Compounds |
| 56-87-1 (RT) | Lysine | 5% to 355% | Amino Acids and related Compounds |
| 56-89-3 (RT) | Cysteine | NEW | Amino Acids and related Compounds |
| 60-18-4 (RT) | Tyrosine | NEW | Amino Acids and related Compounds |
| 61-90-5 (RT) | Leucine | NEW | Amino Acids and related Compounds |
| 63-91-2 (RT) | Phenylalanine | NEW | Amino Acids and related Compounds |
| 71-00-1 (RT) | Histidine | NEW | Amino Acids and related Compounds |
| 72-18-4 (RT) | Valine | 100% to 245% | Amino Acids and related Compounds |
| 72-19-5 (RT) | Threonine | 20% to 260% | Amino Acids and related Compounds |
| 74-79-3 (RT) | Arginine | 25% to 1225% | Amino Acids and related Compounds |
| 999999-99-9 | F2-U1.354 18:1 Isomer | NEW | Fatty Acid |

FIGURE 10-E

A list of metabolite compounds present in altered levels relative to reference samples as characterized by gas and liquid chromatography and mass spectrometry. This list corresponds to samples transfected with nucleic acid sequence, Seq 21627 and 21604, SEQ ID NO:281

| Compound CAS# | Compound Name | Modification | Compound Class |
|---|---|---|---|
| 112-80-1 | 9-Octadecenoic acid (9Z)- | 70% to 220% | Acids - Fatty |
| 28874-30-8 | 7,10,13-Docosatrienoic acid, (7Z,10Z,13Z)- | 60% to 100% | Acids - Fatty |
| 506-12-7 | Heptadecanoic acid | 60% to 110% | Acids - Fatty |
| 506-30-9 | Eicosanoic acid | 60% to 110% | Acids - Fatty |
| 57-10-3 (RT) | Hexadecanoic acid | 5% to 19% | Acids - Fatty |
| 57-11-4 | Octadecanoic acid | 150% to 250% | Acids - Fatty |
| 60-33-3 | 9,12-Octadecadienoic acid | 70% to 130% | Acids - Fatty |
| 14721-66-5 | Hexadecanoic acid, 3,7,11,15-tetramethyl- | NEW | Acids - Fatty Branched |
| 4669-02-7 | Pentadecanoic acid, 14-methyl- | NEW | Acids - Fatty Branched |
| 5918-29-6 | Hexadecanoic acid, 14-methyl- | 70% to 120% | Acids - Fatty Branched |
| 463-40-1 (RT) | 9,12,15-Octadecatrienoic acid | -3% to -13% | Acids - Fatty Unsat |
| 4706-60-9 (RT) | 7,10,13-Hexadecatrienoic acid | -41% to -59% | Acids - Fatty Unsat |
| 147-85-3 (RT) | Proline | 25% to 450% | Amino Acids and related Compounds |
| 56-41-7 (RT) | Alanine | 10% to 600% | Amino Acids and related Compounds |
| 56-45-1 (RT) | Serine | 25% to 380% | Amino Acids and related Compounds |
| 56-84-8 (RT) | Aspartic Acid | 30% to 220% | Amino Acids and related Compounds |
| 56-86-0 (RT) | Glutamic Acid | 30% to 250% | Amino Acids and related Compounds |
| 56-87-1 (RT) | Lysine | 20% to 350% | Amino Acids and related Compounds |
| 60-18-4 (RT) | Tyrosine | NEW | Amino Acids and related Compounds |
| 61-90-5 (RT) | Leucine | 40% to NEW | Amino Acids and related Compounds |
| 63-91-2 (RT) | Phenylalanine | NEW | Amino Acids and related Compounds |
| 71-00-1 (RT) | Histidine | 85% to 320% | Amino Acids and related Compounds |
| 72-18-4 (RT) | Valine | 30% to 3500% | Amino Acids and related Compounds |
| 72-19-5 (RT) | Threonine | 50% to 900% | Amino Acids and related Compounds |
| 73-32-5 (RT) | Isoleucine | NEW | Amino Acids and related Compounds |
| 74-79-3 (RT) | Arginine | 20% to 725% | Amino Acids and related Compounds |
| 77899-10-6 | 14-Tricosen-1-ol, formate, (Z)- | NQ | Esters |
| 999999-99-9 | F1-U1.065 Unknown Fatty Acid Ester | -60% to -80% | Fatty Acid |
| 999999-99-9 | F1-U1.076 Unknown Fatty Acid | -60% to -80% | Fatty Acid |
| 999999-99-9 | F1-U1.113 Unknown Fatty Acid | -60% to 80% | Fatty Acid |
| 999999-99-9 | F1-U1.118 Unknown Fatty Acid | -60% to -90% | Fatty Acid |
| 999999-99-9 | F2-U1.15 | 170% to 210% | Fatty Acid |
| 999999-99-9 | F1-U1.12 Unknown Fatty Acid | -60% to -90% | Fatty Acid |
| 2277-28-3 | 9,12-Octadecadienoic acid (9Z,12Z)-, 2,3-dihydroxypropyl ester | 100% to 140% | Glycerides |
| 23470-00-0 | Glyceryl palmitate | 100% to 150% | Glycerides |
| 14745-36-9 | alpha-Tocopherol hydroquinone | 60% to 500% | Sterols, Oxygenated Terpenes and other Isoprenoids |

FIGURE 10-F

| Compound CAS# | Compound Name | Modification | Compound Class |
|---|---|---|---|
| 148-03-8 | beta-Tocopherol | NEW | Sterols, Oxygenated Terpenes and other Isoprenoids |
| 18525-35-4 | Stigmast-7-en-3-ol, (3b,5a,24S)- | NEW | Sterols, Oxygenated Terpenes and other Isoprenoids |
| 469-38-5 | Cycloartenol | 130% to 170% | Sterols, Oxygenated Terpenes and other Isoprenoids |
| 474-62-4 | Campesterol | 70% to 130% | Sterols, Oxygenated Terpenes and other Isoprenoids |
| 57-88-5 | Cholesterol | 60% to 80% | Sterols, Oxygenated Terpenes and other Isoprenoids |
| 59-02-9 | alpha-Tocopherol | 60% to 300% | Sterols, Oxygenated Terpenes and other Isoprenoids |
| 7616-22-0 | gamma-Tocopherol | NEW | Sterols, Oxygenated Terpenes and other Isoprenoids |
| 83-46-5 | beta-Sitosterol | 70% to 190% | Sterols, Oxygenated Terpenes and other Isoprenoids |
| 83-48-7 | Stigmasterol | 130% to 180% | Sterols, Oxygenated Terpenes and other Isoprenoids |
| 999999-99-9 | F1-U1.111 | 80% to 120% | NA |
| 999999-99-9 | F1-U1.112 | 60% to 110% | NA |
| 999999-99-9 | F1-U1.153 | -60% to -80% | NA |
| 999999-99-9 | F1-U1.164 | NEW | NA |
| 999999-99-9 | F1-U1.171 | NEW | NA |
| 999999-99-9 | F1-U1.197 | NEW | NA |
| 999999-99-9 | F1-U1.2 | NEW | NA |
| 999999-99-9 | F1-U1.23 | 60% to 90% | NA |
| 999999-99-9 | F1-U1.242 | 60% to 90% | NA |

FIGURE 10-G

A list of metabolite compounds present in altered levels relative to reference samples as chararacterized by gas and liquid chromatography and mass spectrometry. This list corresponds to samples transfected with nucleic acid sequence, Seq 23242, SEQ ID NO:282

| Compound CAS# | Compound Name | Modification | Compound Class |
|---|---|---|---|
| 327-97-9 | Chlorogenic acid | NEW | Acids |
| 331-39-5 | Caffeic acid | NEW | Acids |
| 6915-15-7 | Malic acid | 70% to 270% | Acids |
| 7664-38-2 | Phosphoric acid | 80% to 220% | Acids |
| 77-92-9 | Citric acid | 620% to 660% | Acids |
| 112-80-1 | 9-Octadecenoic acid (9Z)- | 120% to 160% | Acids - Fatty |
| 112-85-6 | Docosanoic acid | NEW | Acids - Fatty |
| 506-12-7 | Heptadecanoic acid | NEW | Acids - Fatty |
| 506-30-9 | Eicosanoic acid | 130% to 170% | Acids - Fatty |
| 57-10-3 (RT) | Hexadecanoic acid | 5% to 31% | Acids - Fatty |
| 57-11-4 (RT) | Octadecanoic acid | 9% to 77% | Acids - Fatty |
| 2724-58-5 | 16-Methyl-Heptadecanoic acid | 60% to 90% | Acids - Fatty Branched |
| 5918-29-6 (RT) | 14-methyl-Hexadecanoic acid | -17% to -29% | Acids - Fatty Branched |
| 764-67-0 | Hexadecanoic acid, 2-hydroxy- | NQ | Acids - Fatty Hydroxy |
| 373-49-9 (RT) | 9-Hexadecenoic acid | -13% to -51% | Acids - Fatty Unsat |
| 463-40-1 (RT) | 9,12,15-Octadecatrienoic acid | -3% to -15% | Acids - Fatty Unsat |
| 10191-35-2 | Butanoic acid, 2,3,4-trihydroxy- | NEW | Acids - Hydroxy |
| 88246-12-2 | Butanoic acid, 3,4-dihydroxy-, methyl ester | NEW | Acids - Hydroxy |
| 6917-35-7 | Inositol | 660% to 160% | Alcohols |
| 7683-64-9 | Squalene, non-differentiated isomeric form | 170% to NEW | Alkenes and Alkynes |
| 147-85-3 | L-Proline | 310% to NEW | Amino Acids and related Compounds |
| 3130-87-8 | Asparagine | NEW | Amino Acids and related Compounds |
| 6899-04-3 | Glutamine | NEW | Amino Acids and related Compounds |
| 56-41-7 | L-Alanine | NEW | Amino Acids and related Compounds |
| 56-45-1 | L-Serine | NEW | Amino Acids and related Compounds |
| 56-84-8 | L-Aspartic acid | NEW | Amino Acids and related Compounds |
| 56-86-0 | L-Glutamic acid | NEW | Amino Acids and related Compounds |
| 56-87-1 | L-Lysine | NEW | Amino Acids and related Compounds |
| 60-18-4 | L-Tyrosine | NEW | Amino Acids and related Compounds |
| 6899-04-3 | Glutamine | NEW | Amino Acids and related Compounds |
| 70-47-3 | L-Asparagine | NEW | Amino Acids and related Compounds |
| 72-18-4 | L-Valine | NEW | Amino Acids and related Compounds |

FIGURE 10-H

| Compound CAS# | Compound Name | Modification | Compound Class |
|---|---|---|---|
| 73-22-3 | L-Tryptophan | NEW | Amino Acids and related Compounds |
| 73-32-5 | L-Isoleucine | NEW | Amino Acids and related Compounds |
| 98-79-3 | L-Proline, 5-oxo- | 550% to 590% | Amino Acids and related Compounds |
| 74-79-3 (RT) | Arginine | 85% to 945% | Amino Acids and related Compounds |
| 56-89-3 (RT) | Cysteine | NEW | Amino Acids and related Compounds |
| 71-00-1 (RT) | Histidine | 300% to 800% | Amino Acids and related Compounds |
| 61-90-5 (RT) | Leucine | 1000% to New | Amino Acids and related Compounds |
| 63-68-3 (RT) | Methionine | 135% to 305% | Amino Acids and related Compounds |
| 63-91-2 (RT) | Phenylalanine | 460% to New | Amino Acids and related Compounds |
| 72-19-5 (RT) | Threonine | 75% to 1060% | Amino Acids and related Compounds |
| 999999-99-9 | Citric acid & Carbohydrate | 230% to 4410% | Carbohydrate |
| 999999-99-9 | F3-U0.813 Carbohydrate | 370% to 420% | Carbohydrate |
| 999999-99-9 | F3-U0.815 Carbohydrate | 300% to NEW | Carbohydrate |
| 999999-99-9 | F3-U0.816 Carbohydrate | 650% to 690% | Carbohydrate |
| 999999-99-9 | F3-U0.845 Carbohydrate | 730% to 770% | Carbohydrate |
| 999999-99-9 | F3-U1.150 Carbohydrate | NQ | Carbohydrate |
| 999999-99-9 | F3-U0.872 Hexose | 230% to NEW | Carbohydrates |
| 26566-61-0 | Galactose | NEW | Carbohydrates |
| 50-99-7 | Glucose | 160% to 960% | Carbohydrates |
| 57-48-7 | Fructose (chiral) | 80% to 1910% | Carbohydrates |
| 609-06-3 | L-Xylose | NEW | Carbohydrates |
| 999999-99-9 | F3-U0.846 Carbohydrate | 220% to 1000% | Carbohydrate |
| 999999-99-9 | F3-U0.848 Carbohydrate | 280% to NEW | Carbohydrate |
| 999999-99-9 | F3-U0.826 Carbohydrate | NEW | Carbohydrate |
| 999999-99-9 | F1-U1.065 Unknown Fatty Acid | 120% to 300% | Fatty Acid |
| 999999-99-9 | F1-U1.075 Unknown Fatty Acid Ester | 70% to 140% | Fatty Acid |
| 999999-99-9 | F1-U1.112 Unknown Fatty Acid Ester | 160% to 420% | Fatty Acid |
| 999999-99-9 | F1-U1.12 Unknown Fatty Acid | 100% to 390% | Fatty Acid |
| 57-03-4 | Glyceryl phosphate | NEW | Glycerides |
| 1560-72-1 | Triacontane, 2-methyl- | 370% to 410% | Hydrocarbon |
| 2277-28-3 | 9,12-Octadecadienoic acid (9Z,12Z)-, 2,3-dihydroxypropyl ester | 130% to 170% | Hydroxy Fatty Acid |
| 55429-67-9 | Eicosanoic acid, 2,3-bis(acetyloxy)propyl ester | 60% to 80% | Hydroxy Fatty Acid |
| 138-59-0 | Shikimic acid | NQ | Phenols and Related Compounds |
| 77-95-2 | Quinic acid | 150% to 190% | Phenols and Related Compounds |
| 99-96-7 | Benzoic acid, 4-hydroxy- | NEW | Phenols and Related Compounds |
| 999999-99-9 | F1-U1.2 Unknown Sterol | NEW | Sterol |
| 999999-99-9 | F1-U1.216 Unknown Sterol | NEW | Sterol |

FIGURE 10-I

| Compound CAS# | Compound Name | Modification | Compound Class |
|---|---|---|---|
| 102491-96-3 | Stigmasta-3,5,22-triene, (22E)- | 90% to NEW | Sterols, Oxygenated Terpenes and other Isoprenoids |
| 1176-52-9 | Lophenol, 24-methylene- | NEW | Sterols, Oxygenated Terpenes and other Isoprenoids |
| 13190-97-1 | Solanesol | NEW | Sterols, Oxygenated Terpenes and other Isoprenoids |
| 1449-09-8 | Cycloartanol, 24-methylene- | NEW | Sterols, Oxygenated Terpenes and other Isoprenoids |
| 14745-36-9 | alpha-Tocopherol hydroquinone | 300% to NEW | Sterols, Oxygenated Terpenes and other Isoprenoids |
| 148-03-8 | beta-Tocopherol | NEW | Sterols, Oxygenated Terpenes and other Isoprenoids |
| 16910-32-0 | Ergosta-8,24(28)-dien-3-ol, 4,14-dimethyl-, (3b,4a,5a)- | NEW | Sterols, Oxygenated Terpenes and other Isoprenoids |
| 16910-32-0 | Obtusifoliol | NEW | Sterols, Oxygenated Terpenes and other Isoprenoids |
| 17605-67-3 | Fucosterol | 60% to 210% | Sterols, Oxygenated Terpenes and other Isoprenoids |
| 18865-44-6 | Ergost-22-en-3-one, (5b,22E)- | NEW | Sterols, Oxygenated Terpenes and other Isoprenoids |
| 469-38-5 | Cycloartenol | 80% to NEW | Sterols, Oxygenated Terpenes and other Isoprenoids |
| 469-38-5 | Cycloartenol | 160% to 240% | Sterols, Oxygenated Terpenes and other Isoprenoids |
| 474-62-4 | Campesterol | 100% to NEW | Sterols, Oxygenated Terpenes and other Isoprenoids |
| 54482-54-1 | Stigmasta-5,22-dien-3-ol, acetate, (3b,22Z)- | 70% to 120% | Sterols, Oxygenated Terpenes and other Isoprenoids |
| 57-88-5 | Cholesterol | 120% to 1680% | Sterols, Oxygenated Terpenes and other Isoprenoids |
| 59-02-9 | alpha-Tocopherol | NEW | Sterols, Oxygenated Terpenes and other Isoprenoids |
| 7616-22-0 | gamma-Tocopherol | 80% to 180% | Sterols, Oxygenated Terpenes and other Isoprenoids |
| 83-46-5 | beta-Sitosterol | 120% to 300% | Sterols, Oxygenated Terpenes and other Isoprenoids |
| 83-48-7 | Stigmasterol | NEW | Sterols, Oxygenated Terpenes and other Isoprenoids |
| 999999-99-9 | F1-U0.972 | 150% to 190% | NA |
| 999999-99-9 | F1-U1.136 | NEW | NA |
| 999999-99-9 | F1-U1.246 | 210% to 250% | NA |
| 999999-99-9 | F3-U0.539 | 290% to 330% | NA |
| 999999-99-9 | F3-U0.552 | 320% to 360% | NA |
| 999999-99-9 | F3-U0.588 | NEW | NA |
| 999999-99-9 | F3-U0.59 | NEW | NA |
| 999999-99-9 | F3-U0.592 | NEW | NA |
| 999999-99-9 | F3-U0.635 | NEW | NA |
| 999999-99-9 | F3-U0.666 | NQ | NA |
| 999999-99-9 | F3-U0.705 | NEW | NA |
| 999999-99-9 | F3-U0.716 | NEW | NA |
| 999999-99-9 | F3-U0.717 | NEW | NA |
| 999999-99-9 | F3-U0.736 | 210% to NEW | NA |
| 999999-99-9 | F3-U0.739 | NEW | NA |
| 999999-99-9 | F3-U0.74 | NEW | NA |
| 999999-99-9 | F3-U0.741 | NEW | NA |
| 999999-99-9 | F3-U0.743 | NEW | NA |
| 999999-99-9 | F3-U0.751 | 450% to 490% | NA |

FIGURE 10-J

| Compound CAS# | Compound Name | Modification | | Compound Class |
|---|---|---|---|---|
| 999999-99-9 | F3-U0.752 | NEW | NA | |
| 999999-99-9 | F3-U0.767 | 70% to 110% | NA | |
| 999999-99-9 | F3-U0.782 | NEW | NA | |
| 999999-99-9 | F3-U0.784 | NEW | NA | |
| 999999-99-9 | F3-U0.791 | NEW | NA | |
| 999999-99-9 | F3-U0.801 | 190% to 230% | NA | |
| 999999-99-9 | F3-U0.802 | NEW | NA | |
| 999999-99-9 | F3-U0.813 | NEW | NA | |
| 999999-99-9 | F3-U0.83 | NEW | NA | |
| 999999-99-9 | F3-U0.838 | NEW | NA | |
| 999999-99-9 | F3-U0.843 | 410% to NEW | NA | |
| 999999-99-9 | F3-U0.852 | NEW | NA | |
| 999999-99-9 | F3-U0.853 | 130% to 170% | NA | |
| 999999-99-9 | F3-U0.858 | NEW | NA | |
| 999999-99-9 | F3-U0.866 | NEW | NA | |
| 999999-99-9 | F3-U0.868 | NEW | NA | |
| 999999-99-9 | F3-U0.882 | 100% to 250% | NA | |
| 999999-99-9 | F3-U0.883 | 170% to 210% | NA | |
| 999999-99-9 | F3-U0.895 | NEW | NA | |
| 999999-99-9 | F3-U0.945 | NEW | NA | |
| 999999-99-9 | F3-U0.966 | NEW | NA | |
| 999999-99-9 | F3-U0.992 | NEW | NA | |
| 999999-99-9 | F3-U1.037 | NEW | NA | |
| 999999-99-9 | F3-U1.069 | NEW | NA | |
| 999999-99-9 | F3-U1.076 | NEW | NA | |
| 999999-99-9 | F3-U1.09 | NEW | NA | |
| 999999-99-9 | F3-U1.114 | NEW | NA | |
| 999999-99-9 | F3-U1.12 | NEW | NA | |
| 999999-99-9 | F3-U1.149 | NEW | NA | |
| 999999-99-9 | F3-U1.16 | NEW | NA | |
| 999999-99-9 | F3-U1.177 | 60% to 100% | NA | |
| 999999-99-9 | F3-U1.189 | 60% to 90% | NA | |
| 999999-99-9 | F3-U1.194 | 130% to 220% | NA | |
| 999999-99-9 | F3-U1.214 | NEW | NA | |
| 999999-99-9 | F3-U1.227 | 60% to 80% | NA | |
| 999999-99-9 | F3-U1.228 | NEW | NA | |
| 999999-99-9 | F3-U1.229 | NEW | NA | |
| 999999-99-9 | F3-U1.253 | 180% to NEW | NA | |

FIGURE 10-K

| Compound CAS# | Compound Name | Modification | Compound Class |
|---|---|---|---|
| 999999-99-9 | F3-U1.255 | NEW | NA |

FIGURE 10-L

A list of metabolite compounds present in altered levels relative to reference samples as chararacterized by gas and liquid chromatography and mass spectrometry. This list corresponds to samples transfected with nucleic acid sequence, Seq 23869, SEQ ID NO:283

| Compound CAS# | Compound Name | Modification | Compound Class |
|---|---|---|---|
| 999999-99-9 | Citric acid & Carbohydrate | 160% to 360% | Acid & Carbohydrate |
| 124-04-9 | Hexanedioic acid | NQ | Acids |
| 7664-38-2 | Phosphoric acid | -60% to -90% | Acids |
| 6915-15-7 | Malic acid | -60% to -95% | Acids |
| 463-77-4 | Carbamic acid | -60% to -90% | Acids |
| 77-92-9 | Citric acid | 150% to 360% | Acids |
| 57-10-3 (RT) | Hexadecanoic acid | 10% to 42% | Acids - Fatty |
| 5918-29-6 (RT) | 14-Methyl-hexadecanoic acid | -18% to -30% | Acids - Fatty Branched |
| 373-49-9 (RT) | 9-Hexadecenoic acid | -21% to -36% | Acids - Fatty Unsat |
| 4706-60-9 (RT) | 7,10,13-Hexadecatrienoic acid | -26% to -46% | Acids - Fatty Unsat |
| 463-40-1 (RT) | 9,12,15-Octadecatrienoic acid | -2% to -11% | Acids - Fatty Unsat |
| 6917-35-7 | Inositol | -50% to -92% | Alcohols |
| 7683-64-9 | Squalene | NQ | Alkenes and Alkynes |
| 56-84-8 | Aspartic acid | NEW | Amino Acids and related Compounds |
| 56-86-0 | Glutamic acid | 400% to NEW | Amino Acids and related Compounds |
| 56-87-1 | Lysine | NEW | Amino Acids and related Compounds |
| 3130-87-8 | Asparagine | 500% to NEW | Amino Acids and related Compounds |
| 98-79-3 | L-Proline, 5-oxo- | 100% to 425% | Amino Acids and related Compounds |
| 56-41-7 (RT) | Alanine | 65% to 960% | Amino Acids and related Compounds |
| 74-79-3 (RT) | Arginine | 40% to 3725% | Amino Acids and related Compounds |
| 71-00-1 (RT) | Histidine | 100% to NEW | Amino Acids and related Compounds |
| 73-32-5 (RT) | Isoleucine | NEW | Amino Acids and related Compounds |
| 61-90-5 (RT) | Leucine | 215% to NEW | Amino Acids and related Compounds |
| 63-68-3 (RT) | Methionine | 110% to 950% | Amino Acids and related Compounds |
| 63-91-2 (RT) | Phenylalanine | NEW | Amino Acids and related Compounds |
| 56-45-1 (RT) | Serine | 50% to 455% | Amino Acids and related Compounds |
| 72-19-5 (RT) | Threonine | 150% to 1200% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 72-18-4 (RT) | Valine | 35% to 4720% | Amino Acids and related Compounds |
| 999999-99-9 | F3-U0.813 Carbohydrate | 130% to 160% | Carbohydrate |
| 999999-99-9 | F3-U0.825 Carbohydrate | NEW | Carbohydrate |
| 50-99-7 | Glucose | -50% to NQ | Carbohydrates |
| 57-48-7 | Fructose | -80% to NQ | Carbohydrates |
| 23470-00-0 | Hexadecanoic acid, 2-hydroxy-1-(hydroxymethyl)ethyl ester | NQ | Dihydroxy Fatty Acid |
| 3443-82-1 | 9,12-Octadecadienoic acid (Z,Z)-, 2-hydroxy-1-(hydroxymethyl)ethyl ester | NQ | Dihydroxy Fatty Acid |

FIGURE 10-M

| Compound CAS# | Compound Name | Modification | Compound Class |
|---|---|---|---|
| 74367-34-3 | Propanoic acid, 2-methyl-, 3-hydroxy-2,4,4-trimethylpentyl ester | NEW | Esters, hydroxy |
| 999999-99-9 | F1-U1.076 Unknown Fatty Acid ester | 60% to 120% | Fatty Acid |
| 999999-99-9 | F1-U1.113 Unknown Fatty Acid Ester | 60% to 100% | Fatty Acid |
| 999999-99-9 | F1-U1.067 Unknown Fatty Acid Ester | 155% to 260% | Fatty Acid |
| 999999-99-9 | F1-U1.112 Unknown Fatty Acid Ester | 300% to 500% | Fatty Acid |
| 999999-99-9 | F1-U1.078 Unknown Fatty Acid Ester | -60% to -80% | Fatty Acid |
| 999999-99-9 | F1-U1.113 Fatty Acid Ester | -60% to -80% | Fatty Acid |
| 999999-99-9 | F1-U1.119 Fatty Acid Ester | -60% to -90% | Fatty Acid |
| 544-63-8 | Tetradecanoic acid | NEW | Fatty Acids |
| 57-11-4 | Octadecanoic acid | 27% to 203% | Fatty Acids |
| 14721-66-5 | Hexadecanoic acid, 3,7,11,15-tetramethyl- | NEW | Fatty Acids (Branched) |
| 2724-58-5 | 16-Methyl-Heptadecanoic acid | 190% to 210% | Fatty Acids (Branched) |
| 6250-72-2 | Isoeicosanoic acid | NEW | Fatty Acids (Branched) |
| 112-95-8 | Eicosane | NQ | Hydrocarbon |
| 88246-12-2 | Butanoic acid, 3,4-dihydroxy-, methyl ester | NQ | Hydroxy Acids |
| 764-67-0 | 2-Hydroxy-Hexadecanoic acid | NQ | Hydroxy Fatty Acid |
| 77-95-2 | Quinic acid | -65% to NQ | Phenols and Related Compounds |
| 0-00-0 | 24-methyl-3-oxo-29-norlanostan-10,11.bet | 60% to 100% | Sterols, Oxygenated Terpenes and other Isoprenoids |
| 14745-36-9 | Alpha-Tocopherol hydroquinone | -80% to NQ | Sterols, Oxygenated Terpenes and other Isoprenoids |
| 148-03-8 | beta-Tocopherol | NEW | Sterols, Oxygenated Terpenes and other Isoprenoids |
| 17605-67-3 | Fucosterol | 75% to 130% | Sterols, Oxygenated Terpenes and other Isoprenoids |
| 20780-41-0 | Ergosta-5,24-dien-3-ol, (3.beta.)- | 80% to 120% | Sterols, Oxygenated Terpenes and other Isoprenoids |
| 469-38-5 | Cycloartenol | NQ | Sterols, Oxygenated Terpenes and other Isoprenoids |
| 474-62-4 | Campesterol | 90% to 180% | Sterols, Oxygenated Terpenes and other Isoprenoids |
| 474-63-5 | 24-Methylenecholesterol | NQ | Sterols, Oxygenated Terpenes and other Isoprenoids |
| 57-88-5 | Cholesterol | 70% to 100% | Sterols, Oxygenated Terpenes and other Isoprenoids |
| 59-02-9 | alpha-Tocopherol | 60% to 950% | Sterols, Oxygenated Terpenes and other Isoprenoids |
| 7616-22-0 | gamma.-Tocopherol | NEW | Sterols, Oxygenated Terpenes and other Isoprenoids |
| 83-46-5 | beta.-Sitosterol | 60% to 300% | Sterols, Oxygenated Terpenes and other Isoprenoids |
| 83-48-7 | Stigmasterol Stigmasta-5,22-dien-3-ol | 60% to 120% | Sterols, Oxygenated Terpenes and other Isoprenoids |
| 999999-99-9 | F1-U1.228 Unknown Sterol | -60% to -90% | Sterols, Oxygenated Terpenes and other Isoprenoids |
| 999999-99-9 | F1-U1.198 Unknown Sterol | NQ | Sterols, Oxygenated Terpenes and other Isoprenoids |
| 999999-99-9 | Stigmasterol Analog | NEW | Sterols, Oxygenated Terpenes and other Isoprenoids |
| 999999-99-9 | Stigmasterol Derivative | NEW | Sterols, Oxygenated Terpenes and other Isoprenoids |
| 999999-99-9 | F3-U0.864 Sorbose-like sugar | -60% to -80% | Sugar |

FIGURE 10-N

A list of metabolite compounds present in altered levels relative to reference samples as chararacterized by liquid chromatography. This list corresponds to samples transfected with nucleic acid sequence, Seq 25004, SEQ ID NO:284

| Compound CAS# (RT) | Compound Name | Modification | Compound Class |
|---|---|---|---|
| 56-41-7 (RT) | Alanine | 145% to 335% | Amino Acids and related Compounds |
| 74-79-3 (RT) | Arginine | 60% to 320% | Amino Acids and related Compounds |
| 56-84-8 (RT) | Aspartic Acid | 115% to 225% | Amino Acids and related Compounds |
| 56-86-0 (RT) | Glutamic Acid | 40% to 110% | Amino Acids and related Compounds |
| 56-40-6 (RT) | Glycine | 260% to 2500% | Amino Acids and related Compounds |
| 73-32-5 (RT) | Isoleucine | New | Amino Acids and related Compounds |
| 61-90-5 (RT) | Leucine | New | Amino Acids and related Compounds |
| 56-87-1 (RT) | Lysine | 25% to 400% | Amino Acids and related Compounds |
| 63-68-3 (RT) | Methionine | 50% to 110% | Amino Acids and related Compounds |
| 63-91-2 (RT) | Phenylalanine | New | Amino Acids and related Compounds |
| 56-45-1 (RT) | Serine | 25% to 230% | Amino Acids and related Compounds |
| 72-19-5 (RT) | Threonine | 40% to 440% | Amino Acids and related Compounds |
| 60-18-4 (RT) | Tyrosine | New | Amino Acids and related Compounds |
| 72-18-4 (RT) | Valine | 35% to 620% | Amino Acids and related Compounds |

FIGURE 10-O

A list of metabolite compounds present in altered levels relative to reference samples as chararacterized by liquid chromatography. This list corresponds to samples transfected with nucleic acid sequence, Seq 25008, SEQ ID NO:285

| Compound CAS# | Compound Name | Modification | Compound Class |
|---|---|---|---|
| 74-79-3 (RT) | Arginine | 150% to 320% | Amino Acids and related Compounds |
| 56-89-3 (RT) | Cysteine | New | Amino Acids and related Compounds |
| 56-40-6 (RT) | Glycine | 350% to 3100% | Amino Acids and related Compounds |
| 61-90-5 (RT) | Leucine | New | Amino Acids and related Compounds |
| 63-91-2 (RT) | Phenylalanine | New | Amino Acids and related Compounds |
| 72-19-5 (RT) | Threonine | 25% to 260% | Amino Acids and related Compounds |

FIGURE 10-P

A list of metabolite compounds present in altered levels relative to reference samples as chararacterized by gas chromatography. This list corresponds to samples transfected with nucleic acid sequence, Seq 25009, SEQ ID NO:286

| Compound CAS# | Compound Name | Modification | Compound Class |
|---|---|---|---|
| 5918-29-6 (RT) | 14-methyl-Hexadecanoic acid | -35% to -58% | Acids - Fatty Branched |
| 60-33-3 (RT) | 9,12-Octadecadienoic acid | 4% to 33% | Acids - Fatty Unsat |

FIGURE 10-Q

A list of metabolite compounds present in altered levels relative to reference samples as chararacterized by gas chromatography. This list corresponds to samples transfected with nucleic acid sequence, Seq 25011, SEQ ID NO:287

| Compound CAS# (RT) | Compound Name | Modification | Compound Class |
|---|---|---|---|
| 112-80-1 (RT) | 9-Octadecenoic acid | 33% to 129% | Acids - Fatty Unsat |
| 60-33-3 (RT) | 9,12-Octadecadienoic acid | 11% to 31% | Acids - Fatty Unsat |
| 463-40-1 (RT) | 9,12,15-Octadecatrienoic acid | -5% to -7% | Acids - Fatty Unsat |

FIGURE 10-R

A list of metabolite compounds present in altered levels relative to reference samples as chararacterized by gas and liquid chromatography and mass spectrometry. This list corresponds to samples transfected with nucleic acid sequence, Seq 25015, SEQ ID NO:288

| Compound CAS# | Compound Name | Modification | Compound Class |
|---|---|---|---|
| 112-80-1 | 9-Octadecenoic acid (9Z)- | 80% to 1830% | Acids - Fatty |
| 28874-30-8 | 7,10,13-Docosatrienoic acid, (7Z,10Z,13Z)- | 70% to 80% | Acids - Fatty |
| 373-49-9 | 9-Hexadecenoic acid (9Z)- | 80% to 560% | Acids - Fatty |
| 57-10-3 | Hexadecanoic acid | 60% to 100% | Acids - Fatty |
| 57-11-4 | Octadecanoic acid | 70% to 170% | Acids - Fatty |
| 60-33-3 | 9,12-Octadecadienoic acid, (9Z,12Z)- | 70% to 150% | Acids - Fatty |
| 506-30-9 (RT) | Eicosanoic acid | -31% to -49% | Acids - Fatty |
| 2724-58-5 | Heptadecanoic acid, 16-methyl- | 110% to 150% | Acids - Fatty Branched |
| 5918-29-6 | Hexadecanoic acid, 14-methyl- | 110% to 180% | Acids - Fatty Branched |
| 373-49-9 (RT) | 9-Hexadecenoic acid | -27% to -46% | Acids - Fatty Unsat |
| 463-40-1 (RT) | 9,12,15-Octadecatrienoic acid | -3% to -17% | Acids - Fatty Unsat |
| 56-41-7 (RT) | Alanine | 50% to 260% | Amino Acids and related Compounds |
| 74-79-3 (RT) | Arginine | 10% to 530% | Amino Acids and related Compounds |
| 56-89-3 (RT) | Cysteine | NEW | Amino Acids and related Compounds |
| 56-86-0 (RT) | Glutamic Acid | 20% to 160% | Amino Acids and related Compounds |
| 56-40-6 (RT) | Glycine | NEW | Amino Acids and related Compounds |
| 71-00-1 (RT) | Histidine | 25% to 190% | Amino Acids and related Compounds |
| 56-87-1 (RT) | Lysine | 100% to 215% | Amino Acids and related Compounds |
| 63-91-2 (RT) | Phenylalanine | 100% to 1100% | Amino Acids and related Compounds |
| 147-85-3 (RT) | Proline | 100% to 400% | Amino Acids and related Compounds |
| 56-45-1 (RT) | Serine | 90% to 400% | Amino Acids and related Compounds |
| 72-19-5 (RT) | Threonine | 15% to 500% | Amino Acids and related Compounds |
| 60-18-4 (RT) | Tyrosine | NEW | Amino Acids and related Compounds |
| 72-18-4 (RT) | Valine | 40% to 190% | Amino Acids and related Compounds |
| 999999-99-9 | F2-U1.15 | 370% to 410% | NA |

FIGURE 10-S

A list of metabolite compounds present in altered levels relative to reference samples as characterized by gas and liquid chromatography and mass spectrometry. This list corresponds to samples transfected with nucleic acid sequence, Seq 25026, SEQ ID NO:289

| Compound CAS# | Compound Name | Modification | Compound Class |
|---|---|---|---|
| 463-77-4 | Carbamic acid | -60% to -90% | Acids |
| 77-92-9 | Citric acid | 250% to 300% | Acids |
| 6915-15-7 | Malic acid | 60% to 210% | Acids - Hydroxy Alpha |
| 6917-35-7 | Inositol | 100% to 160% | Alcohols |
| 6899-04-3 | Glutamine | NEW | Amino Acids and related Compounds |
| 56-84-8 | L-Aspartic acid | NEW | Amino Acids and related Compounds |
| 70-47-3 | L-Asparagine | NEW | Amino Acids and related Compounds |
| 56-41-7 (RT) | Alanine | 70% to 255% | Amino Acids and related Compounds |
| 74-79-3 (RT) | Arginine | 515% to 930% | Amino Acids and related Compounds |
| 71-00-1 (RT) | Histidine | 215% to 1650% | Amino Acids and related Compounds |
| 73-32-5 (RT) | Isoleucine | NEW | Amino Acids and related Compounds |
| 61-90-5 (RT) | Leucine | 15% to 350% | Amino Acids and related Compounds |
| 56-87-1 (RT) | Lysine | 815% to 1200% | Amino Acids and related Compounds |
| 63-68-3 (RT) | Methionine | NEW | Amino Acids and related Compounds |
| 63-91-2 (RT) | Phenylalanine | 160% to 340% | Amino Acids and related Compounds |
| 147-85-3 (RT) | Proline | 90% to 410% | Amino Acids and related Compounds |
| 56-45-1 (RT) | Serine | 100% to 410% | Amino Acids and related Compounds |
| 72-19-5 (RT) | Threonine | NEW | Amino Acids and related Compounds |
| 73-22-3 (RT) | Tryptophane | NEW | Amino Acids and related Compounds |
| 60-18-4 (RT) | Tyrosine | 15% to 3850% | Amino Acids and related Compounds |
| 72-18-4 (RT) | Valine | 350% to 400% | Amino Acids and related Compounds |
| 999999-99-9 | F3-U0.815 Carbohydrate | 100% to 500% | Carbohydrate |
| 999999-99-9 | F3-U0.872S Hexose | 80% to 120% | Carbohydrate |
| 999999-99-9 | F3-U1.149 Carbohydrate | 120% to 160% | Carbohydrate |
| 999999-99-9 | F3-U1.194 Carbohydrate | 60% to 2350% | Carbohydrate |
| 50-99-7 | Glucose | 60% to 1800% | Carbohydrates |
| 57-48-7 | Fructose (chiral) | 700% to 730% | Carbohydrates |
| 999999-99-9 | F3-U0.846 Carbohydrate | 100% to 150% | Carbohydrates |
| 77-95-2 | Quinic acid | -60% to -90% | Phenols and Related Compounds |
| 999999-99-9 | F3-U0.668 | NQ | NA |
| 999999-99-9 | F3-U0.713 | NEW | NA |
| 999999-99-9 | F3-U0.838 | NEW | NA |

FIGURE 10-T

| Compound CAS# | Compound Name | Modification | | Compound Class |
|---|---|---|---|---|
| 999999-99-9 | F3-U0.842 | NEW | NA | |
| 999999-99-9 | F3-U0.852 | NEW | NA | |
| 999999-99-9 | F3-U1.229 | -60% to NQ | NA | |
| 999999-99-9 | F3-U1.231 | NQ | NA | |

FIGURE 10-U

A list of metabolite compounds present in altered levels relative to reference samples as chararacterized by liquid chromatography. This list corresponds to samples transfected with nucleic acid sequence, Seq 25057, SEQ ID NO:338

| Compound CAS# | Compound Name | Modification | Compound Class |
|---|---|---|---|
| 71-00-1 (RT) | Histidine | NEW | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 63-68-3 (RT) | Methionine | NEW | Amino Acids and related Compounds |
| 63-91-2 (RT) | Phenylalanine | NEW | Amino Acids and related Compounds |
| 56-45-1 (RT) | Serine | 25% to 230% | Amino Acids and related Compounds |
| 72-19-5 (RT) | Threonine | 55% to 340% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 72-18-4 (RT) | Valine | 425% to 1480% | Amino Acids and related Compounds |

FIGURE 10-V

A list of metabolite compounds present in altered levels relative to reference samples as characterized by gas chromatography and mass spectrometry. This list corresponds to samples transfected with nucleic acid sequence, Seq 25062, SEQ ID NO:290

| Compound CAS# | Compound Name | Modification | Compound Class |
|---|---|---|---|
| 112-80-1 | 9-Octadecenoic acid (9Z)- | 240% to 1180% | Acids - Fatty |
| 373-49-9 | 9-Hexadecenoic acid (9Z)- | 510% to 550% | Acids - Fatty |
| 57-11-4 | Octadecanoic acid | 60% to 100% | Acids - Fatty |
| 5918-29-6 | Hexadecanoic acid, 14-methyl- | 90% to 130% | Acids - Fatty Branched |
| 60-33-3 (RT) | 9,12-Octadecadienoic acid | 7% to 53% | Acids - Fatty Unsat |
| 463-40-1 (RT) | 9,12,15-Octadecatrienoic acid | -3% to -9% | Acids - Fatty Unsat |

FIGURE 10-W

A list of metabolite compounds present in altered levels relative to reference samples as chararacterized by gas chromatography and mass spectrometry. This list corresponds to samples transfected with nucleic acid sequence, Seq 25104, SEQ ID NO:291

| Compound CAS# | Compound Name | Modification | Compound Class |
|---|---|---|---|
| 373-49-9 | 9-Hexadecenoic acid (9Z)- | 360% to 400% | Acids - Fatty |
| 5918-29-6 | Hexadecanoic acid, 14-methyl- | 60% to 90% | Acids - Fatty Branched |
| 112-80-1 (RT) | 9-Octadecenoic acid | 35% to 135% | Acids - Fatty Unsat |
| 60-33-3 (RT) | 9,12-Octadecadienoic acid | 13% to 61% | Acids - Fatty Unsat |
| 463-40-1 (RT) | 9,12,15-Octadecatrienoic acid | -5% to -9% | Acids - Fatty Unsat |

FIGURE 10-X

A list of metabolite compounds present in altered levels relative to reference samples as chararacterized by gas chromatography and mass spectrometry. This list corresponds to samples transfected with nucleic acid sequence, Seq 25118, SEQ ID NO:292

| Compound CAS# | Compound Name | Modification | Compound Class |
|---|---|---|---|
| 6915-15-7 | Malic acid | 180% to 230% | Acids |
| 77-92-9 | Citric acid | 90% to 130% | Acids |
| 112-80-1 | 9-Octadecenoic acid (9Z)- | 1270% to 1310% | Acids - Fatty Unsat |
| 463-40-1 (RT) | 9,12,15-Octadecatrienoic acid | -3% to -9% | Acids - Fatty Unsat |
| 147-85-3 | L-Proline | NQ | Amino Acids and related Compounds |
| 6899-04-3 | Glutamine | NEW | Amino Acids and related Compounds |
| 50-99-7 | Glucose | 130% to 180% | Carbohydrates |
| 999999-99-9 | F3-U0.813 Carbohydrate | 70% to 120% | Carbohydrates |
| 999999-99-9 | F3-U0.846 Carbohydrate | 140% to 180% | Carbohydrates |
| 999999-99-9 | F3-U0.872S Hexose | 200% to 240% | Carbohydrates |
| 77-95-2 | Quinic acid | 100% to 150% | Phenols and Related Compounds |
| 999999-99-9 | F3-U0.526 | NEW | NA |
| 999999-99-9 | F3-U0.547 | NEW | NA |
| 999999-99-9 | F3-U0.569 | NEW | NA |
| 999999-99-9 | F3-U0.667 | NQ | NA |
| 999999-99-9 | F3-U0.736 | NEW | NA |
| 999999-99-9 | F3-U0.767 | NEW | NA |
| 999999-99-9 | F3-U0.843 | -60% to -80% | NA |
| 999999-99-9 | F3-U0.852 | NEW | NA |
| 999999-99-9 | F3-U0.858 | NEW | NA |
| 999999-99-9 | F3-U1.069 | NEW | NA |

FIGURE 10-Y

A list of metabolite compounds present in altered levels relative to reference samples as characterized by gas and liquid chromatography and mass spectrometry. This list corresponds to samples transfected with nucleic acid sequence, Seq 25124, SEQ ID NO:293

| Compound CAS# | Compound Name | Modification | Compound Class |
|---|---|---|---|
| 6915-15-7 | Malic acid | 80% to 130% | Acids |
| 327-97-9 | Chlorogenic acid | NEW | Acids |
| 463-77-4 | Carbamic acid | -60% to -80% | Acids |
| 7664-38-2 | Phosphoric acid | 80% to 130% | Acids |
| 77-92-9 | Citric acid | 270% to 600% | Acids |
| 6917-35-7 | Inositol | 60% to 110% | Alcohols |
| 110-60-1 | 1,4-Butanediamine | NEW | Alkaloids and Other Bases |
| 7683-64-9 | Squalene, non-differentiated isomeric form | NEW | Alkenes and Alkynes |
| 56-84-8 | L-Aspartic acid | NEW | Amino Acids and related Compounds |
| 56-86-0 | L-Glutamic acid | NEW | Amino Acids and related Compounds |
| 98-79-3 | L-Proline, 5-oxo- | 70% to 130% | Amino Acids and related Compounds |
| 56-41-7 (RT) | Alanine | 40% to 195% | Amino Acids and related Compounds |
| 71-00-1 (RT) | Histidine | NEW | Amino Acids and related Compounds |
| 72-19-5 (RT) | Threonine | 60% to 250% | Amino Acids and related Compounds |
| 60-18-4 (RT) | Tyrosine | NEW | Amino Acids and related Compounds |
| 72-18-4 (RT) | Valine | 65% to 535% | Amino Acids and related Compounds |
| 999999-99-9 | F3-U0.813 Carbohydrate | NEW | Carbohydrate |
| 999999-99-9 | F3-U0.814 Carbohydrate | NEW | Carbohydrate |
| 999999-99-9 | F3-U0.815 Carbohydrate | NEW | Carbohydrate |
| 999999-99-9 | F3-U0.816 Carbohydrate | 580% to 630% | Carbohydrate |
| 999999-99-9 | F3-U0.825 Carbohydrate | NEW | Carbohydrate |
| 999999-99-9 | F3-U0.826 Carbohydrate | NEW | Carbohydrate |
| 999999-99-9 | F3-U0.845 Carbohydrate | 900% to 950% | Carbohydrate |
| 999999-99-9 | F3-U0.846 Carbohydrate | 660% to 700% | Carbohydrate |
| 999999-99-9 | F3-U0.872S Hexose | 700% to NEW | Carbohydrate |
| 999999-99-9 | F3U1.072 Carbohydrate | NQ | Carbohydrate |
| 999999-99-9 | F3-U1.081 Carbohydrate | NQ | Carbohydrate |
| 999999-99-9 | F3-U1.149 Carbohydrate | 60% to 80% | Carbohydrate |
| 50-99-7 | Glucose | 70% to 2300% | Carbohydrates |
| 57-48-7 | Fructose (chiral) | 70% to 1400% | Carbohydrates |
| 59-02-9 | alpha-Tocopherol | 90% to 200% | Sterols, Oxygenated Terpenes and other Isoprenoids |
| 999999-99-9 | F1-U0.873 | NEW | NA |

FIGURE 10-Z

| Compound CAS# | Compound Name | Modification | Compound Class |
|---|---|---|---|
| 999999-99-9 | F3-U0.768 | NEW | NA |
| 999999-99-9 | F3-U0.785 | NEW | NA |
| 999999-99-9 | F3-U0.842 | NEW | NA |
| 999999-99-9 | F3-U0.848 | NEW | NA |
| 999999-99-9 | F3-U0.853 | NEW | NA |
| 999999-99-9 | F3-U1.232 | NQ | NA |

FIGURE 10-AA

A list of metabolite compounds present in altered levels relative to reference samples as characterized by gas chromatography and mass spectrometry. This list corresponds to samples transfected with nucleic acid sequence, Seq 25133, SEQ ID NO:294

| Compound CAS# | Compound Name | Modification | Compound Class |
|---|---|---|---|
| 112-80-1 | 9-Octadecenoic acid (9Z)- | 140% to 180% | Acids - Fatty |
| 28874-30-8 | 7,10,13-Docosatrienoic acid, (7Z,10Z,13Z)- | 60% to 100% | Acids - Fatty |
| 373-49-9 | 9-Hexadecenoic acid (9Z)- | 720% to 760% | Acids - Fatty |
| 5918-29-6 | Hexadecanoic acid, 14-methyl- | 60% to 90% | Acids - Fatty Branched |
| 60-33-3 (RT) | 9,12-Octadecadienoic acid | 6% to 29% | Acids - Fatty Unsat |
| 463-40-1 (RT) | 9,12,15-Octadecatrienoic acid | -1% to -5% | Acids - Fatty Unsat |

FIGURE 10-BB

A list of metabolite compounds present in altered levels relative to reference samples as chararacterized by gas chromatography and mass spectrometry. This list corresponds to samples transfected with nucleic acid sequence, Seq 25144, SEQ ID NO:295

| Compound CAS# | Compound Name | Modification | Compound Class |
|---|---|---|---|
| 112-80-1 | 9-Octadecenoic acid (9Z)- | 1160% to 1200% | Acids - Fatty |
| 57-11-4 | Octadecanoic acid | 60% to 80% | Acids - Fatty |
| 5918-29-6 | Hexadecanoic acid, 14-methyl- | 70% to 110% | Acids - Fatty Branched |
| 57-10-3 (RT) | Hexadecanoic acid | 4% to 10% | Acids - Fatty |
| 60-33-3 (RT) | 9,12-Octadecadienoic acid | 17% to 43% | Acids - Fatty Unsat |
| 463-40-1 (RT) | 9,12,15-Octadecatrienoic acid | -5% to -11% | Acids - Fatty Unsat |

FIGURE 10-CC

A list of metabolite compounds present in altered levels relative to reference samples as chararacterized by gas and liquid chromatography and mass spectrometry. This list corresponds to samples transfected with nucleic acid sequence, Seq 25164, SEQ ID NO:296

| Compound CAS# | Compound Name | Modification | Compound Class |
|---|---|---|---|
| 327-97-9 | Chlorogenic acid | 60% to 80% | Acids |
| 463-77-4 | Carbamic acid | 60% to 100% | Acids |
| 6915-15-7 | Malic acid | 160% to 200% | Acids |
| 7664-38-2 | Phosphoric acid | 80% to 170% | Acids |
| 77-92-9 | Citric acid | 150% to 180% | Acids |
| 110-60-1 | 1,4-Butanediamine | NEW | Alkaloids and Other Bases |
| 147-85-3 | L-Proline | NEW | Amino Acids and related Compounds |
| 6899-04-3 | Glutamine | NEW | Amino Acids and related Compounds |
| 56-84-8 | L-Aspartic acid | NEW | Amino Acids and related Compounds |
| 60-18-4 | L-Tyrosine | NEW | Amino Acids and related Compounds |
| 98-79-3 | L-Proline, 5-oxo- | 130% to 180% | Amino Acids and related Compounds |
| 56-41-7 (RT) | Alanine | 100% to 330% | Amino Acids and related Compounds |
| 74-79-3 (RT) | Arginine | NEW | Amino Acids and related Compounds |
| 56-86-0 (RT) | Glutamic Acid | 45% to 120% | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 63-91-2 (RT) | Phenylalanine | 155% to 1400% | Amino Acids and related Compounds |
| 56-45-1 (RT) | Serine | 170% to 360% | Amino Acids and related Compounds |
| 72-19-5 (RT) | Threonine | 135% to 560% | Amino Acids and related Compounds |
| 73-22-3 (RT) | Tryptophane | NEW | Amino Acids and related Compounds |
| 72-18-4 (RT) | Valine | 480% to 1630% | Amino Acids and related Compounds |
| 999999-99-9 | F3-U0.813 Carbohydrate | 60% to 450% | Carbohydrate |
| 999999-99-9 | F3-U0.816 Carbohydrate | 70% to 220% | Carbohydrate |
| 999999-99-9 | F3-U0.845 Carbohydrate | 110% to 160% | Carbohydrate |
| 999999-99-9 | F3-U0.846 Carbohydrate | 260% to 380% | Carbohydrate |
| 999999-99-9 | F3-U0.872S Hexose | 270% to 320% | Carbohydrate |
| 999999-99-9 | F3-U0.876 Hexose | NEW | Carbohydrate |
| 999999-99-9 | F3-U1.150 Carbohydrate | 150% to 200% | Carbohydrate |
| 999999-99-9 | F3-U1.189 Carbohydrate | 60% to 100% | Carbohydrate |
| 50-99-7 | Glucose | 400% to 1200% | Carbohydrates |
| 57-48-7 | Fructose (chiral) | 400% to 1000% | Carbohydrates |
| 3327-61-5 | .alpha.-D-Glucopyranose, 1,2,3,4,6-penta | NEW | Carbohydrates |

FIGURE 10-DD

| Compound CAS# | Compound Name | Modification | | Compound Class |
|---|---|---|---|---|
| 999999-99-9 | F3-U0.742 | NEW | NA | |
| 999999-99-9 | F3-U0.783 | NEW | NA | |
| 999999-99-9 | F3-U0.82 | 150% to 190% | NA | |
| 999999-99-9 | F3-U0.838 | NEW | NA | |
| 999999-99-9 | F3-U0.852 | NEW | NA | |
| 999999-99-9 | F3-U0.882 | NEW | NA | |
| 999999-99-9 | F3-U0.903 | 110% to 160% | NA | |
| 999999-99-9 | F3-U1.177 | -50% to -90% | NA | |
| 999999-99-9 | F3-U1.253 | 60% to 90% | NA | |
| 999999-99-9 | F3-U1.274 | NEW | NA | |

FIGURE 10-EE

A list of metabolite compounds present in altered levels relative to reference samples as chararacterized by gas and liquid chromatography and mass spectrometry. This list corresponds to samples transfected with nucleic acid sequence, Seq 25170, SEQ ID NO:297

| Compound CAS# | Compound Name | Modification | Compound Class |
|---|---|---|---|
| 327-97-9 | Chlorogenic acid | 320% to 360% | Acids |
| 463-77-4 | Carbamic acid | 60% to 90% | Acids |
| 6915-15-7 | Malic acid | 70% to 110% | Acids |
| 7664-38-2 | Phosphoric acid | 110% to 150% | Acids |
| 77-92-9 | Citric acid | 130% to 170% | Acids |
| 112-80-1 | 9-Octadecenoic acid (9Z)- | 90% to 300% | Acids - Fatty |
| 373-49-9 | 9-Hexadecenoic acid (9Z)- | NEW | Acids - Fatty |
| 506-12-7 | Heptadecanoic acid | NEW | Acids - Fatty |
| 506-30-9 | Eicosanoic acid | 100% to 130% | Acids - Fatty |
| 57-10-3 | Hexadecanoic acid | 60% to 80% | Acids - Fatty |
| 57-11-4 | Octadecanoic acid | 140% to 180% | Acids - Fatty |
| 60-33-3 | 9,12-Octadecadienoic acid, (9Z,12Z)- | 200% to 240% | Acids - Fatty |
| 2724-58-5 | 16-methyl-Heptadecanoic acid | 150% to 190% | Acids - Fatty Branched |
| 5918-29-6 | Hexadecanoic acid, 14-methyl- | 130% to 170% | Acids - Fatty Branched |
| 463-40-1 (RT) | 9,12,15-Octadecatrienoic acid | -3% to -11% | Acids - Fatty Unsat |
| 6917-35-7 | Inositol | 90% to 130% | Alcohols |
| 110-60-1 | 1,4-Butanediamine | NEW | Alkaloids and Other Bases |
| 147-85-3 | L-Proline | NEW | Amino Acids and related Compounds |
| 3130-87-8 | Asparagine | NEW | Amino Acids and related Compounds |
| 56-40-6 | Glycine | NEW | Amino Acids and related Compounds |
| 56-84-8 | L-Aspartic acid | NEW | Amino Acids and related Compounds |
| 56-86-0 | L-Glutamic acid | NEW | Amino Acids and related Compounds |
| 70-47-3 | L-Asparagine | NEW | Amino Acids and related Compounds |
| 98-79-3 | L-Proline, 5-oxo- | 250% to 290% | Amino Acids and related Compounds |
| 74-79-3 (RT) | Arginine | 215% to 915% | Amino Acids and related Compounds |
| 56-89-3 (RT) | Cysteine | NEW | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 56-87-1 (RT) | Lysine | 15% to 360% | Amino Acids and related Compounds |
| 63-91-2 (RT) | Phenylalanine | NEW | Amino Acids and related Compounds |
| 56-45-1 (RT) | Serine | 20% to 230% | Amino Acids and related Compounds |

FIGURE 10-FF

| 72-19-5 (RT) | Threonine | 100% to 450% | Amino Acids and related Compounds |
|---|---|---|---|
| 60-18-4 (RT) | Tyrosine | NEW | Amino Acids and related Compounds |
| 72-18-4 (RT) | Valine | 5% to 600% | Amino Acids and related Compounds |
| 999999-99-9 | F3-U0.846 Carbohydrate | 310% to 730% | Carbohydrate |
| 999999-99-9 | F3-U0.816 Carbohydrate | 60% to 90% | Carbohydrate |
| 999999-99-9 | F3-U0.812 | NEW | Carbohydrate |
| 999999-99-9 | F3-U0.815 | NEW | Carbohydrate |
| 999999-99-9 | F3-U0.815 Carbohydrate | 200% to 240% | Carbohydrate |
| 999999-99-9 | F3-U0.845 | 530% to 570% | Carbohydrate |
| 999999-99-9 | F3-U0.872 | 319.20% | Carbohydrate |
| 999999-99-9 | F3-U0.872 Hexose | 320% to 910% | Carbohydrate |
| 999999-99-9 | F3-U1.150 Carbohydrate | 60% to 90% | Carbohydrate |
| 999999-99-9 | F3-U1.189 Carbohydrate | 70% to NEW | Carbohydrate |
| 999999-99-9 | F3-U1.194 Carbohydrate | 80% to 120% | Carbohydrate |
| 50-99-7 | Glucose | 290% to NEW | Carbohydrates |
| 57-48-7 | Fructose (chiral) | 80% to 1000% | Carbohydrates |
| 999999-99-9 | F2-U1.15 Unknown Fatty Acid | 320% to 360% | Fatty Acid |
| 999999-99-9 | F3-U0.713 | NQ | NA |
| 999999-99-9 | F3-U0.751 | 100% to NEW | NA |
| 999999-99-9 | F3-U0.782 | NEW | NA |
| 999999-99-9 | F3-U0.821 | 210% to 250% | NA |
| 999999-99-9 | F3-U0.842 | NEW | NA |
| 999999-99-9 | F3-U0.903 | 60% to 100% | NA |

FIGURE 10-GG

A list of metabolite compounds present in altered levels relative to reference samples as chararacterized by gas and liquid chromatography and mass spectrometry. This list corresponds to samples transfected with nucleic acid sequence, Seq 25176 and 25119, SEQ ID NO:298

| Compound CAS# | Compound Name | Modification | Compound Class |
|---|---|---|---|
| 999999-99-9 | Citric acid & Carbohydrate | 200% to 240% | Acid & Carbohydrate |
| 100-21-0 | Terephthalic acid | -60% to -90% | Acids |
| 6915-15-7 | Malic acid | 120% to 160% | Acids |
| 373-49-9 | 9-Hexadecenoic acid (9Z)- | 670% to 710% | Acids - Fatty |
| 57-11-4 | Octadecanoic acid | 60% to 80% | Acids - Fatty |
| 5918-29-6 | Hexadecanoic acid, 14-methyl- | 70% to 110% | Acids - Fatty Branched |
| 112-80-1 (RT) | 9-Octadecenoic acid | 177% to 113% | Acids - Fatty Unsat |
| 463-40-1 (RT) | 9,12,15-Octadecatrienoic acid | -3% to -7% | Acids - Fatty Unsat |
| 60-33-3 (RT) | 9,12-Octadecadienoic acid | 11% to 35% | Acids - Fatty Unsat |
| 6917-35-7 | Inositol | 60% to 120% | Alcohols |
| 147-85-3 | L-Proline | 100% to 160% | Amino Acids and related Compounds |
| 56-40-6 | Glycine | NEW | Amino Acids and related Compounds |
| 56-84-8 | L-Aspartic acid | 90% to 140% | Amino Acids and related Compounds |
| 56-86-0 | L-Glutamic acid | NEW | Amino Acids and related Compounds |
| 56-87-1 | L-Lysine | NEW | Amino Acids and related Compounds |
| 56-89-3 (RT) | Cysteine | 185% to 410% | Amino Acids and related Compounds |
| 63-91-2 (RT) | Phenylalanine | NEW | Amino Acids and related Compounds |
| 72-19-5 (RT) | Threonine | 20% to 310% | Amino Acids and related Compounds |
| 73-22-3 (RT) | Tryptophane | NEW | Amino Acids and related Compounds |
| 74-79-3 (RT) | Arginine | 235% to 1065% | Amino Acids and related Compounds |
| 98-79-3 | L-Proline, 5-oxo- | 60% to 80% | Amino Acids and related Compounds |
| 999999-99-9 | F3-U0.816 Carbohydrate | 60% to 90% | Carbohydrate |
| 999999-99-9 | F3-U0.846 Carbohydrate | 180% to 600% | Carbohydrate |
| 999999-99-9 | F3-U0.872S Hexose | 200% to 650% | Carbohydrate |
| 50-99-7 | Glucose | 200% to 600% | Carbohydrates |
| 57-48-7 | Fructose (chiral) | 110% to 200% | Carbohydrates |
| 77-92-9 | Citric acid | 60% to 80% | Hydroxy Carboxylic Acids |
| 77-95-2 | Quinic acid | 60% to 90% | Phenols and Related Compounds |
| 999999-99-9 | F3-U0.667 | 60% to 90% | NA |
| 999999-99-9 | F3-U0.688 | 60% to 90% | NA |
| 999999-99-9 | F3-U0.751 | NEW | NA |
| 999999-99-9 | F3-U0.782 | NEW | NA |

FIGURE 10-HH

| Comp und CAS# | Compound Name | Modification | Compound Class |
|---|---|---|---|
| 999999-99-9 | F3-U0.814 | 120% to 160% | NA |
| 999999-99-9 | F3-U0.825 | 70% to 110% | NA |
| 999999-99-9 | F3-U0.838 | NEW | NA |
| 999999-99-9 | F3-U0.842 | 120% to 160% | NA |
| 999999-99-9 | F3-U0.843 | NEW | NA |
| 999999-99-9 | F3-U0.856 | NEW | NA |
| 999999-99-9 | F3-U0.882 | 120% to 170% | NA |

FIGURE 10-II

A list of metabolite compounds present in altered levels relative to reference samples as chararacterized by gas and liquid chromatography and mass spectrometry. This list corresponds to samples transfected with nucleic acid sequence, Seq 25196 and 25195, SEQ ID NO:299

| Compound CAS# | Compound Name | Modification | Compound Class |
|---|---|---|---|
| 999999-99-9 | Citric acid & Carbohydrate | 340% to 900% | Acid & Carbohydrate |
| 327-97-9 | Chlorogenic acid | NEW | Acids |
| 463-77-4 | Carbamic acid | -60% to -80% | Acids |
| 6000-40-4 | Glyceric acid | NEW | Acids |
| 6915-15-7 | Malic acid | 100% to 130% | Acids |
| 7664-38-2 | Phosphoric acid | 80% to 120% | Acids |
| 28874-30-8 | 7,10,13-Docosatrienoic acid, (7Z,10Z,13Z)- | 100% to 140% | Acids - Fatty |
| 373-49-9 | 9-Hexadecenoic acid (9Z)- | 70% to 110% | Acids - Fatty |
| 6000-30-9 | Eicosanoic acid | 70% to 110% | Acids - Fatty |
| 57-10-3 (RT) | Hexadecanoic acid | 3% to 17% | Acids - Fatty |
| 2724-58-5 | 16-methyl-Heptadecanoic acid | -60% to -80% | Acids - Fatty Branched |
| 5918-29-6 (RT) | 14-methyl-Hexadecanoic acid | -25% to -41% | Acids - Fatty Branched |
| 6917-35-7 | Inositol | 100% to 120% | Alcohols |
| 138-86-3 | Limonene | NEW | Alkenes and Alkynes |
| 7683-64-9 | Squalene, non-differentiated isomeric form | NQ | Alkenes and Alkynes |
| 56-41-7 (RT) | Alanine | 70% to 325% | Amino Acids and related Compounds |
| 56-45-1 (RT) | Serine | 55% to 340% | Amino Acids and related Compounds |
| 56-84-8 | L-Aspartic acid | 60% to 100% | Amino Acids and related Compounds |
| 56-84-8 (RT) | Aspartic Acid | 30% to 100% | Amino Acids and related Compounds |
| 56-86-0 (RT) | Glutamic Acid | 25% to 145% | Amino Acids and related Compounds |
| 60-18-4 (RT) | Tyrosine | NEW | Amino Acids and related Compounds |
| 61-90-5 (RT) | Leucine | NEW | Amino Acids and related Compounds |
| 63-68-3 (RT) | Methionine | NEW | Amino Acids and related Compounds |
| 63-91-2 (RT) | Phenylalanine | NEW | Amino Acids and related Compounds |
| 71-00-1 (RT) | Histidine | NEW | Amino Acids and related Compounds |
| 72-18-4 (RT) | Valine | 20% to 2300% | Amino Acids and related Compounds |
| 72-18-4 (RT) | Valine | 400% to 1400% | Amino Acids and related Compounds |
| 72-19-5 (RT) | Threonine | 115% to 550% | Amino Acids and related Compounds |
| 73-22-3 (RT) | Tryptophane | NEW | Amino Acids and related Compounds |
| 73-32-5 (RT) | Isoleucine | NEW | Amino Acids and related Compounds |
| 999999-99-9 | F3-U0.794 Carbohydrate | NEW | Carbohydrate |
| 999999-99-9 | F3-U0.813 Carbohydrate | 500% to 540% | Carbohydrate |
| 999999-99-9 | F3-U0.814 Carbohydrate | 720% to 760% | Carbohydrate |

FIGURE 10-JJ

| Compound CAS# | Compound Name | Modification | Compound Class |
|---|---|---|---|
| 999999-99-9 | F3-U0.816 Carbohydrate | 150% to 300% | Carbohydrate |
| 999999-99-9 | F3-U0.817 Carbohydrate | 330% to 370% | Carbohydrate |
| 999999-99-9 | F3-U0.846 Carbohydrate | 380% to 500% | Carbohydrate |
| 999999-99-9 | F3-U0.848 Carbohydrate | NEW | Carbohydrate |
| 999999-99-9 | F3-U0.872 Hexose | 480% to 580% | Carbohydrate |
| 50-99-7 | Glucose | 3320% to 2020% | Carbohydrates |
| 57-48-7 | Fructose (chiral) | 450% to 1440% | Carbohydrates |
| 999999-99-9 | F1-U1.065 Unknown Fatty Acid | 60% to 90% | Fatty Acid |
| 999999-99-9 | F1-U1.075 Unknown Fatty Acid | NEW | Fatty Acid |
| 999999-99-9 | F1-U1.119 Unknown Fatty Acid | 60% to 90% | Fatty Acid |
| 999999-99-9 | F1-U1.121 Unknown Fatty Acid | 70% to 110% | Fatty Acid |
| 1560-72-1 | Triacontane, 2-methyl- | 60% to 90% | Hydrocarbon |
| 77-95-2 | Quinic acid | 140% to 180% | Phenols and Related Compounds |
| 99-96-7 | Benzoic acid, 4-hydroxy- | -60% to -80% | Phenols and Related Compounds |
| 14745-36-9 | alpha-Tocopherol hydroquinone | 70% to NEW | Sterols, Oxygenated Terpenes and other Isoprenoids |
| 148-03-8 | beta-Tocopherol | NEW | Sterols, Oxygenated Terpenes and other Isoprenoids |
| 17605-67-3 | Fucosterol | 60% to 80% | Sterols, Oxygenated Terpenes and other Isoprenoids |
| 469-38-5 | Cycloartenol | 350% to NEW | Sterols, Oxygenated Terpenes and other Isoprenoids |
| 474-62-4 | Campesterol | 70% to 90% | Sterols, Oxygenated Terpenes and other Isoprenoids |
| 511-61-5 | Cyclolaudenol | NEW | Sterols, Oxygenated Terpenes and other Isoprenoids |
| 59-02-9 | alpha-Tocopherol | 70% to 650% | Sterols, Oxygenated Terpenes and other Isoprenoids |
| 7616-22-0 | gamma-Tocopherol | NEW | Sterols, Oxygenated Terpenes and other Isoprenoids |
| 83-46-5 | beta-Sitosterol | 120% to 150% | Sterols, Oxygenated Terpenes and other Isoprenoids |
| 83-48-7 | Stigmasterol | 60% to 100% | Sterols, Oxygenated Terpenes and other Isoprenoids |
| 999999-99-9 | F1-U1.216 Unknown Sterol | NEW | Sterols, Oxygenated Terpenes and other Isoprenoids |
| 999999-99-9 | F3-U0.668 | 80% to 120% | NA |
| 999999-99-9 | F3-U0.843 | NEW | NA |
| 999999-99-9 | F3-U0.882 | 300% to NEW | NA |
| 999999-99-9 | F3-U0.936 | NEW | NA |
| 999999-99-9 | F3-U0.938 | NEW | NA |
| 999999-99-9 | F3-U0.94 | NEW | NA |
| 999999-99-9 | F3-U0.949 | NEW | NA |
| 999999-99-9 | F3-U1.104 | NEW | NA |
| 999999-99-9 | F3-U1.143 | 60% to 100% | NA |

FIGURE 10-KK

A list of metabolite compounds present in altered levels relative to reference samples as chararacterized by liquid chromatography. This list corresponds to samples transfected with nucleic acid sequence, Seq 25414, SEQ ID NO:339

| Compound CAS# (RT) | Compound Name | Modification | Compound Class |
|---|---|---|---|
| 56-87-1 (RT) | Lysine | 25% to 385% | Amino Acids and related Compounds |
| 63-91-2 (RT) | Phenylalanine | NEW | Amino Acids and related Compounds |
| 72-19-5 (RT) | Threonine | 25% to 150% | Amino Acids and related Compounds |
| 60-18-4 (RT) | Tyrosine | NEW | Amino Acids and related Compounds |

FIGURE 10-LL

A list of metabolite compounds present in altered levels relative to reference samples as chararacterized by gas chromatography. This list corresponds to samples transfected with nucleic acid sequence, Seq 25421, SEQ ID NO:300

| Compound CAS# | Compound Name | Modification | Compound Class |
|---|---|---|---|
| 4706-60-9 (RT) | 7,10,13-Hexadecatrienoic acid | 32% to 67% | Acids - Fatty Unsat |
| 60-33-3 (RT) | 9,12-Octadecadienoic acid | 7% to 29% | Acids - Fatty Unsat |
| 463-40-1 (RT) | 9,12,15-Octadecatrienoic acid | -3% to -7% | Acids - Fatty Unsat |

FIGURE 10-MM

A list of metabolite compounds present in altered levels relative to reference samples as chararacterized by liquid chromatography. This list corresponds to samples transfected with nucleic acid sequence, Seq 25425, SEQ ID NO:301

| Compound CAS# | Compound Name | Modification | Compound Class |
|---|---|---|---|
| 73-32-5 (RT) | Isoleucine | NEW | Amino Acids and related Compounds |
| 61-90-5 (RT) | Leucine | 165% to 525% | Amino Acids and related Compounds |
| 56-87-1 (RT) | Lysine | 40% to 500% | Amino Acids and related Compounds |
| 63-68-3 (RT) | Methionine | 100% to 250% | Amino Acids and related Compounds |
| 63-91-2 (RT) | Phenylalanine | NEW | Amino Acids and related Compounds |
| 73-22-3 (RT) | Tryptophane | NEW | Amino Acids and related Compounds |
| 60-18-4 (RT) | Tyrosine | 150% to 420% | Amino Acids and related Compounds |
| 72-18-4 (RT) | Valine | | Amino Acids and related Compounds |

FIGURE 10-NN

| | | | |
|---|---|---|---|
| A list of metabolite compounds present in altered levels relative to reference samples as characterized by gas and liquid chromatography. This list corresponds to samples transfected with nucleic acid sequence, Seq 25431 and 25466, SEQ ID NO:302 | | | |
| Compound CAS# | Compound Name | Modification | Compound Class |
| 124-04-9 | Hexanedioic acid | -60% to -90% | Acids |
| 112-85-6 | Docosanoic acid | NEW | Acids - Fatty |
| 57-11-4 | Octadecanoic acid | 70% to 90% | Acids - Fatty |
| 60-33-3 | 9,12-Octadecadienoic acid, (9Z,12Z)- | 70% to 110% | Acids - Fatty |
| 999999-99-9 | F2-U1.365 Unknown Isomer | NEW | Acids - Fatty |
| 4669-02-7 | Pentadecanoic acid, 14-methyl- | NEW | Acids - Fatty Branched |
| 5918-29-6 (RT) | 14-methyl-Hexadecanoic acid | 17% to 33% | Acids - Fatty Branched |
| 999999-99-9 | Methyl-Eicosanoic acid | NEW | Acids - Fatty Branched |
| 112-80-1 (RT) | 9-Octadecenoic acid | 27% to 143% | Acids - Fatty Unsat |
| 463-40-1 (RT) | 9,12,15-Octadecatrienoic acid | -3% to -13% | Acids - Fatty Unsat |
| 67228-95-9 | 10-Nonadecenoic acid (non-differentiated) | NEW | Acids - Fatty Unsat |
| 56-40-6 (RT) | Glycine | NEW | Amino Acids and related Compounds |
| 56-45-1 (RT) | Serine | 65% to 230% | Amino Acids and related Compounds |
| 56-84-8 (RT) | Aspartic Acid | 25% to 70% | Amino Acids and related Compounds |
| 56-89-3 (RT) | Cysteine | NEW | Amino Acids and related Compounds |
| 71-00-1 (RT) | Histidine | 55% to 480% | Amino Acids and related Compounds |
| 72-18-4 (RT) | Valine | 25% to 275% | Amino Acids and related Compounds |
| 72-19-5 (RT) | Threonine | 75% to 315% | Amino Acids and related Compounds |
| 73-32-5 (RT) | Isoleucine | NEW | Amino Acids and related Compounds |
| 74-79-3 (RT) | Arginine | 30% to 775% | Amino Acids and related Compounds |
| 999999-99-9 | F2-U1.273 (Unknown 16:1 Isomer) | NEW | Fatty Acid |
| 999999-99-9 | F2-U1.15 | 150% to 190% | NA |

FIGURE 10-OO

A list of metabolite compounds present in altered levels relative to reference samples as characterized by gas and liquid chromatography and mass spectrometry. This list corresponds to samples transfected with nucleic acid sequence, Seq 27410, SEQ ID NO:303

| Compound CAS# | Compound Name | Modification | Compound Class |
|---|---|---|---|
| 56-41-7 (RT) | Alanine | 70% to 300% | Amino Acids and related Compounds |
| 56-86-0 (RT) | Glutamic Acid | 40% to 135% | Amino Acids and related Compounds |
| 71-00-1 (RT) | Histidine | NEW | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 56-87-1 (RT) | Lysine | 50% to 490% | Amino Acids and related Compounds |
| 63-68-3 (RT) | Methionine | NEW | Amino Acids and related Compounds |
| 63-91-2 (RT) | Phenylalanine | 280% to New | Amino Acids and related Compounds |
| 147-85-3 (RT) | Proline | 85% to 370% | Amino Acids and related Compounds |
| 56-45-1 (RT) | Serine | 70% to 350% | Amino Acids and related Compounds |
| 72-19-5 (RT) | Threonine | 5% to 590% | Amino Acids and related Compounds |
| 73-22-3 (RT) | Tryptophane | NEW | Amino Acids and related Compounds |
| 60-18-4 (RT) | Tyrosine | 270% to 4700% | Amino Acids and related Compounds |
| 72-18-4 (RT) | Valine | NEW | Amino Acids and related Compounds |
| 111-02-4 | Squalene | NEW | Hydrocarbon |
| 148-03-8 | beta-Tocopherol | -60% to -80% | Sterols, Oxygenated Terpenes and other Isoprenoids |
| 17605-67-3 | Fucosterol | 80.00% to NEW | Sterols, Oxygenated Terpenes and other Isoprenoids |
| 469-38-5 | Cycloartenol | 730% to 770% | Sterols, Oxygenated Terpenes and other Isoprenoids |
| 59-02-9 | alpha-Tocopherol | NEW | Sterols, Oxygenated Terpenes and other Isoprenoids |
| 7616-22-0 | gamma-Tocopherol | NEW | Sterols, Oxygenated Terpenes and other Isoprenoids |
| 999999-99-9 | F1-U0.875 | | NA |

FIGURE 10-PP

A list of metabolite compounds present in altered levels relative to reference samples as chararacterized by liquid chromatography. This list corresponds to samples transfected with nucleic acid sequence, Seq 27424, SEQ ID NO:304

| Compound CAS# | Compound Name | Modification | Compound Class |
|---|---|---|---|
| 74-79-3 (RT) | Arginine | 85% to 240% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 72-19-5 (RT) | Threonine | 50% to 225% | Amino Acids and related Compounds |

FIGURE 10-QQ chromatography and mass spectrometry. This list corresponds to samples transfected with nucleic acid sequence, Seq 27430, SEQ ID NO:306

| Compound CAS# | Compound Name | Modification | Compound Class |
|---|---|---|---|
| 999999-99-9 | Citric acid and Carbohydrate | 880% to 920% | Acid & Carbo |
| 327-97-9 | Chlorogenic acid | NEW | Acids |
| 463-77-4 | Carbamic acid | 580% to 620% | Acids |
| 6915-15-7 | Malic acid | 80% to 120% | Acids - Hydroxy Alpha |
| 98-79-3 | L-Proline, 5-oxo- | 60% to 80% | Amino Acids and related Compounds |
| 999999-99-9 | F3-U0.813 Carbohydrate | 450% to 490% | Carbohydrate |
| 999999-99-9 | F3-U0.816 Carbohydrate | 70% to 280% | Carbohydrate |
| 999999-99-9 | F3-U0.826 Carbohydrate | 230% to 270% | Carbohydrate |
| 999999-99-9 | F3-U0.846 Carbohydrate | 200% to 300% | Carbohydrate |
| 999999-99-9 | F3-U0.872 Hexose | 200% to 300% | Carbohydrate |
| 50-99-7 | Glucose | 160% to 350% | Carbohydrates |
| 57-48-7 | Fructose (chiral) | 60% to 430% | Carbohydrates |
| 999999-99-9 | F3-U0.668 | NEW | NA |
| 999999-99-9 | F3-U0.737 | 160% to 200% | NA |
| 999999-99-9 | F3-U0.752 | 70% to 110% | NA |
| 999999-99-9 | F3-U0.852 | NEW | NA |
| 999999-99-9 | F3-U0.876 | 110% to 150% | NA |
| 999999-99-9 | F3-U0.882 | 90% to 130% | NA |

FIGURE 10-RR

A list of metabolite compounds present in altered levels relative to reference samples as chararacterized by gas chromatography and mass spectrometry. This list corresponds to samples transfected with nucleic acid sequence, Seq 27440, SEQ ID NO:307

| Compound CAS# | Compound Name | Modification | Compound Class |
|---|---|---|---|
| 112-80-1 | 9-Octadecenoic acid (9Z)- | 120% to 1410% | Acids - Fatty |
| 28290-73-5 | 7,10-Hexadecadienoic acid, (7Z,10Z)- | 60% to 80% | Acids - Fatty |
| 373-49-9 | 9-Hexadecenoic acid (9Z)- | 150% to 430% | Acids - Fatty |
| 57-11-4 | Octadecanoic acid | 60% to 80% | Acids - Fatty |
| 60-33-3 | 9,12-Octadecadienoic acid, (9Z,12Z)- | 80% to NEW | Acids - Fatty |
| 5918-29-6 | Hexadecanoic acid, 14-methyl- | 80% to 120% | Acids - Fatty Branched |
| 463-40-1 (RT) | 9,12,15-Octadecatrienoic acid | -1% to -7% | Acids - Fatty Unsat |
| 999999-99-9 | F2-U1.366 | NEW | Fatty Acid |

FIGURE 10-SS

A list of metabolite compounds present in altered levels relative to reference samples as characterized by liquid chromatography. This list corresponds to samples transfected with nucleic acid sequence, Seq 27459, SEQ ID NO:308

| Compound CAS# (RT) | Compound Name | Modification | Compound Class |
|---|---|---|---|
| 74-79-3 (RT) | Arginine | 25% to 625% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 56-87-1 (RT) | Lysine | 375% to 1025% | Amino Acids and related Compounds |

FIGURE 10-TT

A list of metabolite compounds present in altered levels relative to reference samples as chararcterized by gas and liquid chromatography and mass spectrometry. This list corresponds to samples transfected with nucleic acid sequence, Seq 27460, SEQ ID NO:309

| Compound CAS# | Compound Name | Modification | Compound Class |
|---|---|---|---|
| 506-30-9 | Eicosanoic acid | 450% to 490% | Acids - Fatty |
| 5918-29-6 (RT) | 14-methyl-Hexadecanoic acid | 13% to 39% | Acids - Fatty Branched |
| 112-80-1 | 9-Octadecenoic acid | 70 to 113% | Acids - Fatty Unsat |
| 4706-60-9 (RT) | 7,10,13-Hexadecatrienoic acid | -9% to -17% | Acids - Fatty Unsat |
| 60-33-3 (RT) | 9,12-Octadecadienoic acid | 7% to 65% | Acids - Fatty Unsat |
| 463-40-1 (RT) | 9,12,15-Octadecatrienoic acid | -3% to -9% | Acids - Fatty Unsat |
| 74-79-3 (RT) | Arginine | 20% to 500% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 71-00-1 (RT) | Histidine | NEW | Amino Acids and related Compounds |
| 56-45-1 (RT) | Serine | 30% to 105% | Amino Acids and related Compounds |
| 999999-99-9 | F2-U1.151 | 70% to 110% | NA |

FIGURE 10-UU

A list of metabolite compounds present in altered levels relative to reference samples as chararacterized by gas and liquid chromatography and mass spectrometry. This list corresponds to samples transfected with nucleic acid sequence, Seq 27468, SEQ ID NO:310

| Compound CAS# | Compound Name | Modification | Compound Class |
|---|---|---|---|
| 6250-72-2 | Isoeicosanoic acid | 850% to 900% | Acids - Fatty Branched |
| 112-80-1 (RT) | 9-Octadecenoic acid | 22% to 167% | Acids - Fatty Unsat |
| 5918-29-6 (RT) | 14-methyl-Hexadecanoic acid | -23% to -37% | Acids - Fatty Branched |
| 60-33-3 (RT) | 9,12-Octadecadienoic acid | -11% to -29% | Acids - Fatty Unsat |
| 57-11-4 (RT) | Octadecanoic acid | 25% to 43% | Acids - Fatty Unsat |
| 506-30-9 (RT) | Eicosanoic acid | -53% to -75% | Acids - Fatty |
| 74-79-3 (RT) | Arginine | 1% to 415% | Amino Acids and related Compounds |
| 56-89-3 (RT) | Cysteine | NEW | Amino Acids and related Compounds |
| 56-86-0 (RT) | Glutamic Acid | 25% to 100% | Amino Acids and related Compounds |
| 56-40-6 (RT) | Glycine | NEW | Amino Acids and related Compounds |
| 72-19-5 (RT) | Threonine | 50% to 165% | Amino Acids and related Compounds |

FIGURE 10-VV

A list of metabolite compounds present in altered levels reference to control samples as characterized by gas and liquid chromatography and mass spectrometry. This list corresponds to samples transfected with nucleic acid sequence, Seq 27819, SEQ ID NO:311

| Compound CAS# | Compound Name | Modification | Compound Class |
|---|---|---|---|
| 463-77-4 | Carbamic acid | 80% to 300% | Acid |
| 7664-38-2 | Phosphoric acid | 80% to 160% | Acids |
| 57-11-4 (RT) | Octadecanoic acid | 9% to 75% | Acids - Fatty |
| 5918-29-6 (RT) | 14-Methyl-hexadecanoic acid | -30% to -85% | Acids - Fatty Branched |
| 373-49-9 (RT) | 9-Hexadecenoic acid | -11% to -52% | Acids - Fatty Unsat |
| 60-33-3 (RT) | 9,12-Octadecadienoic acid | -11% to -41% | Acids - Fatty Unsat |
| 110-60-1 | 1,4-Butanediamine | NEW | Alkaloids and Other Bases |
| 138-86-3 | Limonene | 800% to NEW | Alkenes and Alkynes |
| 147-85-3 | L-Proline | NEW | Amino Acids and related Compounds |
| 6899-04-3 | Glutamine | NEW | Amino Acids and related Compounds |
| 56-84-8 | L-Aspartic acid | NEW | Amino Acids and related Compounds |
| 56-86-0 | L-Glutamic acid | NEW | Amino Acids and related Compounds |
| 70-47-3 | L-Asparagine | NEW | Amino Acids and related Compounds |
| 72-18-4 | L-Valine | 6600% to 7000% | Amino Acids and related Compounds |
| 98-79-3 | L-Proline, 5-oxo- | 190% to 300% | Amino Acids and related Compounds |
| 71-00-1 (RT) | Histidine | NEW | Amino Acids and related Compounds |
| 73-32-5 (RT) | Isoleucine | 635% to NEW | Amino Acids and related Compounds |
| 61-90-5 (RT) | Leucine | 40% to 1000% | Amino Acids and related Compounds |
| 56-87-1 (RT) | Lysine | 75% to NEW | Amino Acids and related Compounds |
| 63-68-3 (RT) | Methionine | NEW | Amino Acids and related Compounds |
| 63-91-2 (RT) | Phenylalanine | 70% to 290% | Amino Acids and related Compounds |
| 56-45-1 (RT) | Serine | 85% to 935% | Amino Acids and related Compounds |
| 72-19-5 (RT) | Threonine | NEW | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 999999-99-9 | F3-U0.784 | NEW | Carbohydrate |
| 999999-99-9 | F3-U0.794 Pentose | NEW | Carbohydrate |
| 999999-99-9 | F3-U0.813 | 1000% to NEW | Carbohydrate |
| 999999-99-9 | F3-U0.815 | NEW | Carbohydrate |
| 999999-99-9 | F3-U0.816 | 540% to 820% | Carbohydrate |

FIGURE 10-WW

| Compound CAS# | Compound Name | Modification | Compound Class |
|---|---|---|---|
| 999999-99-9 | F3-U0.819 Pentose | NEW | Carbohydrate |
| 999999-99-9 | F3-U0.825 | NEW | Carbohydrate |
| 999999-99-9 | F3-U0.845 Hexose | 300% to 350% | Carbohydrate |
| 999999-99-9 | F3-U0.846 | 300% to NEW | Carbohydrate |
| 999999-99-9 | F3-U0.872 Hexose | 400% to NEW | Carbohydrate |
| 999999-99-9 | F3-U0.876 Hexose | NEW | Carbohydrate |
| 999999-99-9 | F3-U0.882 | 280% to 430% | Carbohydrate |
| 999999-99-9 | F3-U0.89 Hexose | NEW | Carbohydrate |
| 999999-99-9 | F3-U0.894 Hexose | NEW | Carbohydrate |
| 999999-99-9 | F3-U0.907 Hexose | NEW | Carbohydrate |
| 999999-99-9 | F3-U0.948 Hexose | NEW | Carbohydrate |
| 999999-99-9 | F3-U0.949 Hexose | NEW | Carbohydrate |
| 999999-99-9 | F3-U0.952 Hexose | NEW | Carbohydrate |
| 999999-99-9 | F3-U0.956 Hexose | NEW | Carbohydrate |
| 999999-99-9 | F3-U0.992 Sugar acid | NEW | Carbohydrate |
| 999999-99-9 | F3-U1.032 Carbo | NEW | Carbohydrate |
| 999999-99-9 | F3-U1.049 Carbo | NQ | Carbohydrate |
| 999999-99-9 | F3-U1.06 Carbo | NEW | Carbohydrate |
| 999999-99-9 | F3-U1.067 Carbo | NEW | Carbohydrate |
| 999999-99-9 | F3-U1.069 Carbo | NEW | Carbohydrate |
| 999999-99-9 | F3-U1.078 Carbo | NEW | Carbohydrate |
| 999999-99-9 | F3-U1.081 Carbo | NEW | Carbohydrate |
| 999999-99-9 | F3-U1.096 Carbo | NEW | Carbohydrate |
| 999999-99-9 | F3-U1.104 Carbohydrate | NEW | Carbohydrate |
| 999999-99-9 | F3-U1.113 Carbohydrate | NEW | Carbohydrate |
| 999999-99-9 | F3-U1.119 Carbohydrate | NEW | Carbohydrate |
| 999999-99-9 | F3-U1.143 Carbohydrate | NEW | Carbohydrate |
| 999999-99-9 | F3-U1.189 Carbohydrate | 300% to NEW | Carbohydrate |
| 50-99-7 | Glucose | 1000% to NEW | Carbohydrates |
| 57-48-7 | Fructose (chiral) | 800% to 1600% | Carbohydrates |
| 57-50-1 | Sucrose | 70% to 110% | Carbohydrates |
| 58-86-6 | D-Xylose | NEW | Carbohydrates |
| 6917-35-7 | Inositol | 100% to 500% | Carbohydrates |
| 57-10-3 | Hexadecanoic acid | 70% to 90% | Fatty Acid |
| 999999-99-9 | F1-U1.065 Unknown Fatty Acid Ester | 100% to 130% | Fatty Acids |
| 999999-99-9 | F1-U1.068 Unknown Fatty Acid | 70% to 100% | Fatty Acids |

FIGURE 10-XX

| Compound CAS# | Compound Name | Modification | Compound Class |
|---|---|---|---|
| 999999-99-9 | F1-U1.076 Unknown Fatty Acid Ester | 80% to 170% | Fatty Acids |
| 999999-99-9 | F1-U1.113 Unknown Fatty Acid Ester | 100% to 200% | Fatty Acids |
| 999999-99-9 | F1-U1.122 Unknown Fatty Acid | 200% to 260% | Fatty Acids |
| 506-12-7 | Heptadecanoic acid | NEW | Fatty Acids |
| 57-03-4 | Glyceryl phosphate | NEW | Glycerides |
| 88246-12-2 | Butanoic acid, 3,4-dihydroxy-, methyl ester | NEW | Hydroxy Acids |
| 6000-40-4 | Glyceric acid | NEW | Hydroxy Carboxylic Acid |
| 6915-15-7 | Malic acid | 100% to 800% | Hydroxy Carboxylic Acid |
| 77-95-2 | Quinic acid | 110% to 150% | Phenols and Related Compounds |
| 327-97-9 | Chlorogenic acid | 200% to 1000% | Phenylpropanoids and Related Compounds |
| 100021-41-8 | Stigmastan-3,5,22-trien | NEW | Sterols, Oxygenated Terpenes and other Isoprenoids |
| 111-02-4 | Squalene | NEW | Sterols, Oxygenated Terpenes and other Isoprenoids |
| 119-13-1 | delta-Tocopherol | NEW | Sterols, Oxygenated Terpenes and other Isoprenoids |
| 13190-97-1 | Solanesol | NEW | Sterols, Oxygenated Terpenes and other Isoprenoids |
| 14745-36-9 | alpha-Tocopherol hydroquinone | 1100% to NEW | Sterols, Oxygenated Terpenes and other Isoprenoids |
| 148-03-8 | beta-Tocopherol | NEW | Sterols, Oxygenated Terpenes and other Isoprenoids |
| 16910-32-0 | Obtusifoliol | NEW | Sterols, Oxygenated Terpenes and other Isoprenoids |
| 469-38-5 | Cycloartenol | NEW | Sterols, Oxygenated Terpenes and other Isoprenoids |
| 474-62-4 | Campesterol | 80% to 170% | Sterols, Oxygenated Terpenes and other Isoprenoids |
| 511-61-5 | Cyclolaudenol | NEW | Sterols, Oxygenated Terpenes and other Isoprenoids |
| 54482-55-2 | Stigmasta-7,22-dien-3-ol, (3b,5a,22Z)- | 110% to 160% | Sterols, Oxygenated Terpenes and other Isoprenoids |
| 59-02-9 | alpha-Tocopherol | 200% to 1400% | Sterols, Oxygenated Terpenes and other Isoprenoids |
| 7616-22-0 | gamma-Tocopherol | NEW | Sterols, Oxygenated Terpenes and other Isoprenoids |
| 83-46-5 | beta-Sitosterol | 180% to 400% | Sterols, Oxygenated Terpenes and other Isoprenoids |
| 83-48-7 | Stigmasterol | 100% to 200% | Sterols, Oxygenated Terpenes and other Isoprenoids |
| 999999-99-9 | F1-U1.216 Unknown Sterol | NEW | Sterols, Oxygenated Terpenes and other Isoprenoids |
| 999999-99-9 | F1-U1.223 Unknown Sterol | NEW | Sterols, Oxygenated Terpenes and other Isoprenoids |
| 999999-99-9 | F1-U0.872 | NEW | NA |
| 999999-99-9 | F1-U0.957 | NQ | NA |
| 999999-99-9 | F1-U0.971 | NEW | NA |
| 999999-99-9 | F1-U0.972 | NEW | NA |
| 999999-99-9 | F1-U1.228 | NQ | NA |
| 999999-99-9 | F3-U0.539 | NEW | NA |
| 999999-99-9 | F3-U0.552 | NEW | NA |
| 999999-99-9 | F3-U0.556 | NQ | NA |

FIGURE 10-YY

| Compound CAS# | Compound Name | Modification | Compound Class |
|---|---|---|---|
| 999999-99-9 | F3-U0.65 | NEW | NA |
| 999999-99-9 | F3-U0.668 | NQ | NA |
| 999999-99-9 | F3-U0.713 | NQ | NA |
| 999999-99-9 | F3-U0.717 | NEW | NA |
| 999999-99-9 | F3-U0.736 | 650% to NEW | NA |
| 999999-99-9 | F3-U0.742 | NEW | NA |
| 999999-99-9 | F3-U0.746 | NEW | NA |
| 999999-99-9 | F3-U0.751 | NEW | NA |
| 999999-99-9 | F3-U0.768 | NEW | NA |
| 999999-99-9 | F3-U0.781 | NEW | NA |
| 999999-99-9 | F3-U0.783 | NEW | NA |
| 999999-99-9 | F3-U0.791 | NEW | NA |
| 999999-99-9 | F3-U0.801 | NEW | NA |
| 999999-99-9 | F3-U0.802 | NEW | NA |
| 999999-99-9 | F3-U0.83 | NEW | NA |
| 999999-99-9 | F3-U0.836 | NEW | NA |
| 999999-99-9 | F3-U0.844 | NQ | NA |
| 999999-99-9 | F3-U0.848R | NQ | NA |
| 999999-99-9 | F3-U0.848S | 400% to 450% | NA |
| 999999-99-9 | F3-U0.851 | NEW | NA |
| 999999-99-9 | F3-U0.852 | NQ | NA |
| 999999-99-9 | F3-U0.853 | NEW | NA |
| 999999-99-9 | F3-U0.854 | 70% to 300% | NA |
| 999999-99-9 | F3-U0.858 | NEW | NA |
| 999999-99-9 | F3-U0.866 | NEW | NA |
| 999999-99-9 | F3-U0.868 | NQ | NA |
| 999999-99-9 | F3-U0.875S | 800% to 840% | NA |
| 999999-99-9 | F3-U0.883 | NEW | NA |
| 999999-99-9 | F3-U0.896 | NEW | NA |
| 999999-99-9 | F3-U0.899 | 60% to 250% | NA |
| 999999-99-9 | F3-U0.903 | NEW | NA |
| 999999-99-9 | F3-U0.904 | NEW | NA |
| 999999-99-9 | F3-U0.909 | NEW | NA |
| 999999-99-9 | F3-U0.935 | NEW | NA |
| 999999-99-9 | F3-U0.957 | NEW | NA |
| 999999-99-9 | F3-U1.085 | NEW | NA |

FIGURE 10-ZZ

| Compound CAS# | Compound Name | Modification | Compound Class |
|---|---|---|---|
| 999999-99-9 | F3-U1.16 | NEW | NA |
| 999999-99-9 | F3-U1.194 | 190% to 230% | NA |
| 999999-99-9 | F3-U1.214 | NEW | NA |
| 999999-99-9 | F3-U1.233 | 200% to NEW | NA |

FIGURE 10-AAA

A list of metabolite compounds present in altered levels relative to reference samples as chararacterized by gas chromatography and mass spectrometry. This list corresponds to samples transfected with nucleic acid sequence, Seq 27864, SEQ ID NO:312

| Compound CAS# | Compound Name | Modification | Compound Class |
|---|---|---|---|
| 77-92-9 | Citric acid | 150% to 200% | Acids |
| 999999-99-9 | F3-U0.813 Carbohydrate | 80% to 120% | Carbohydrate |
| 999999-99-9 | F3-U0.816 Carbohydrate | 60% to 100% | Carbohydrate |
| 999999-99-9 | F3-U0.826 Carbohydrate | 90% to 140% | Carbohydrate |
| 999999-99-9 | F3-U0.846 Carbohydrate | 60% to 100% | Carbohydrate |
| 999999-99-9 | F3-U0.872S Hexose | 60% to 100% | Carbohydrate |
| 999999-99-9 | F3-U0.751 | 200% to 250% | NA |
| 999999-99-9 | F3-U0.843 | NEW | NA |

FIGURE 10-BBB

A list of metabolite compounds present in altered levels relative to reference samples as chararacterized by gas chromatography and mass spectrometry. This list corresponds to samples transfected with nucleic acid sequence, Seq 30307, SEQ ID NO:314

| Compound CAS# | Compound Name | Modification | Compound Class |
|---|---|---|---|
| 112-80-1 | 9-Octadecenoic acid | 24% to 225% | Acids - Fatty |
| 28874-30-8 | 7,10,13-Docosatrienoic acid, (7Z,10Z,13Z)- | 90% to 170% | Acids - Fatty |
| 373-49-9 | 9-Hexadecenoic acid (9Z)- | 170% to 210% | Acids - Fatty |
| 506-12-7 | Heptadecanoic acid | 60% to 100% | Acids - Fatty |
| 57-10-3 | Hexadecanoic acid | 60% to 190% | Acids - Fatty |
| 57-11-4 | Octadecanoic acid | 70% to 140% | Acids - Fatty |
| 60-33-3 | 9,12-Octadecadienoic acid, (9Z,12Z)- | 80% to 200% | Acids - Fatty |
| 2724-58-5 | Heptadecanoic acid, 16-methyl- | 60% to 80% | Acids - Fatty Branched |
| 5918-29-6 | Hexadecanoic acid, 14-methyl- | 70% to 220% | Acids - Fatty Branched |
| 60-33-3 (RT) | 9,12-Octadecadienoic acid | 7% to 43% | Acids - Fatty Unsat |
| 463-40-1 (RT) | 9,12,15-Octadecatrienoic acid | -1% to -25% | Acids - Fatty Unsat |
| 999999-99-9 | F2-U1.236 | 530% to 570% | Fatty Acid |
| 999999-99-9 | F2-U1.354 Unknown 18:1 Isomer | NEW | Fatty Acid |

FIGURE 10-CCC

A list of metabolite compounds present in altered levels relative to reference samples as chararacterized by gas and liquid chromatography and mass spectrometry. This list corresponds to samples transfected with nucleic acid sequence, Seq 30913, SEQ ID NO:315

| Compound CAS# | Compound Name | Modification | Compound Class |
|---|---|---|---|
| 999999-99-9 | F3-U0.992 Sugar acid | NEW | Acid |
| 999999-99-9 | Citric acid & Carbohydrate | NEW | Acid & Carbohdrate |
| 463-77-4 | Carbamic acid | -70% to -90% | Acids |
| 7664-38-2 | Phosphoric acid | 140% to NEW | Acids |
| 77-92-9 | Citric acid | 100% to NEW | Acids |
| 112-80-1 | 9-Octadecenoic acid (9Z)- | 100% to 800% | Acids - Fatty |
| 112-85-6 | Docosanoic acid | NEW | Acids - Fatty |
| 28874-30-8 | 7,10,13-Docosatrienoic acid, (7Z,10Z,13Z)- | 60% to 80% | Acids - Fatty |
| 373-49-9 | 9-Hexadecenoic acid (9Z)- | 200% to 240% | Acids - Fatty |
| 506-30-9 | Eicosanoic acid | 200% to 820% | Acids - Fatty |
| 57-10-3 | Hexadecanoic acid | 140% to 180% | Acids - Fatty |
| 57-11-4 | Octadecanoic acid | 80% to 370% | Acids - Fatty |
| 60-33-3 | 9,12-Octadecadienoic acid, (9Z,12Z)- | 130% to 170% | Acids - Fatty |
| 2724-58-5 | 16-methyl-Heptadecanoic acid | 70% to 400% | Acids - Fatty Branched |
| 5918-29-6 (RT) | 14-methyl-Hexadecanoic acid | -41% to -57% | Acids - Fatty Branched |
| 6250-72-2 | Isoeicosanoic acid | 400% to 440% | Acids - Fatty Branched |
| 112-80-1 (RT) | 9-Octadecenoic acid | 9% to 373% | Acids - Fatty Unsat |
| 373-49-9 (RT) | 9-Hexadecenoic acid | -17% to -50% | Acids - Fatty Unsat |
| 463-40-1 (RT) | 9,12,15-Octadecatrienoic acid | -5% to -27% | Acids - Fatty Unsat |
| 4706-60-9 (RT) | 7,10,13-Hexadecatrienoic acid | 15% to 53% | Acids - Fatty Unsat |
| 60-33-3 (RT) | 9,12-Octadecadienoic acid | 11% to 37% | Acids - Fatty Unsat |
| 10191-35-2 | Butanoic acid, 2,3,4-trihydroxy- | NEW | Acids - Hydroxy |
| 6915-15-7 | Malic acid | 80% to 300% | Acids - Hydroxy Alpha |
| 6917-35-7 | Inositol | 100% to 420% | Alcohols |
| 147-85-3 | L-Proline | 100% to NEW | Amino Acids and related Compounds |
| 3130-87-8 | Asparagine | NEW | Amino Acids and related Compounds |
| 6899-04-3 | Glutamine | NEW | Amino Acids and related Compounds |
| 56-41-7 (RT) | Alanine | 50% to 650% | Amino Acids and related Compounds |
| 56-45-1 (RT) | Serine | 60% to 400% | Amino Acids and related Compounds |
| 56-84-8 | L-Aspartic acid | NEW | Amino Acids and related Compounds |
| 56-86-0 (RT) | Glutamic Acid | 85% to 190% | Amino Acids and related Compounds |

FIGURE 10-DDD

| Compound CAS# | Compound Name | Modification | Compound Class |
|---|---|---|---|
| 56-87-1 (RT) | Lysine | 85% to 2300% | Amino Acids and related Compounds |
| 58-61-7 | Adenosine | NEW | Amino Acids and related Compounds |
| 60-18-4 (RT) | Tyrosine | New | Amino Acids and related Compounds |
| 61-90-5 (RT) | Leucine | 230% to New | Amino Acids and related Compounds |
| 63-68-3 (RT) | Methionine | 255% to New | Amino Acids and related Compounds |
| 63-91-2 (RT) | Phenylalanine | New | Amino Acids and related Compounds |
| 70-47-3 | L-Asparagine | NEW | Amino Acids and related Compounds |
| 71-00-1 (RT) | Histidine | New | Amino Acids and related Compounds |
| 72-18-4 (RT) | Valine | 80% to 1140% | Amino Acids and related Compounds |
| 72-19-5 | L-Threonine | NEW | Amino Acids and related Compounds |
| 73-22-3 (RT) | Tryptophane | New | Amino Acids and related Compounds |
| 73-32-5 (RT) | Isoleucine | New | Amino Acids and related Compounds |
| 74-79-3 (RT) | Arginine | 250% to 1950% | Amino Acids and related Compounds |
| 98-79-3 | L-Proline, 5-oxo- | 90% to 100% | Amino Acids and related Compounds |
| 999999-99-9 | F3-U0.78 Carbohydrate | NEW | Carbohydrate |
| 999999-99-9 | F3-U0.813 Carbohydrate | 130% to NEW | Carbohydrate |
| 999999-99-9 | F3-U0.815 | 110% to NEW | Carbohydrate |
| 999999-99-9 | F3-U0.816 Carbohydrate | 200% to NEW | Carbohydrate |
| 999999-99-9 | F3-U0.826 Carbohydrate | NQ | Carbohydrate |
| 999999-99-9 | F3-U0.846 | 260% to 300% | Carbohydrate |
| 999999-99-9 | F3-U0.846 Carbohydrate | 100% to NEW | Carbohydrate |
| 999999-99-9 | F3-U0.872 Hexose | 150% to NEW | Carbohydrate |
| 999999-99-9 | F3-U0.948 Carbohydrate | NEW | Carbohydrate |
| 999999-99-9 | F3-U0.948 Hexose | NEW | Carbohydrate |
| 999999-99-9 | F3-U1.038 Carbohydrate | NEW | Carbohydrate |
| 999999-99-9 | F3-U1.039 Carbohydrate | NEW | Carbohydrate |
| 999999-99-9 | F3-U1.101 Carbohydrate | NEW | Carbohydrate |
| 999999-99-9 | F3-U1.104 Carbohydrate | NEW | Carbohydrate |
| 999999-99-9 | F3-U1.119 Carbohydrate | 60% to NEW | Carbohydrate |
| 999999-99-9 | F3-U1.189 Carbohydrate | 200% to 230% | Carbohydrate |
| 999999-99-9 | F3-U1.194 Carbohydrate | 70% to NEW | Carbohydrate |
| 50-99-7 | Glucose | 500% to 3510% | Carbohydrates |
| 57-48-7 | Fructose (chiral) | -70% to NQ | Carbohydrates |
| 57-50-1 | Sucrose | | Carbohydrates |
| 999999-99-9 | F1-U1.065 Unknown Fatty Acid Ester | 60% to 460% | Fatty Acid |
| 999999-99-9 | F1-U1.114 Unknown Fatty Acid Ester | 70% to 100% | Fatty Acid |

FIGURE 10-EEE

| Compound CAS# | Compound Name | Modification | Compound Class |
|---|---|---|---|
| 2277-28-3 | 9,12-Octadecadienoic acid (9Z,12Z)-, 2,3-dihydroxypropyl ester | 480% to 520% | Glycerides |
| 327-97-9 | Chlorogenic acid | 750% to NEW | Phenols and Related Compounds |
| 77-95-2 | Quinic acid | 70% to 250% | Phenols and Related Compounds |
| 1176-52-9 | Lophenol, 24-methylene- | NEW | Sterols, Oxygenated Terpenes and other Isoprenoids |
| 1449-09-8 | Cycloartanol, 24-methylene- | NEW | Sterols, Oxygenated Terpenes and other Isoprenoids |
| 14745-36-9 | alpha-Tocopherol hydroquinone | NEW | Sterols, Oxygenated Terpenes and other Isoprenoids |
| 148-03-8 | beta-Tocopherol | NEW | Sterols, Oxygenated Terpenes and other Isoprenoids |
| 16910-32-0 | Obtusifoliol | NEW | Sterols, Oxygenated Terpenes and other Isoprenoids |
| 17605-67-3 | Fucosterol | 90% to 180% | Sterols, Oxygenated Terpenes and other Isoprenoids |
| 469-38-5 | Cycloartenol | NEW | Sterols, Oxygenated Terpenes and other Isoprenoids |
| 469-39-6 | Cycloeucalenol | NEW | Sterols, Oxygenated Terpenes and other Isoprenoids |
| 474-62-4 | Campesterol | 70% to 400% | Sterols, Oxygenated Terpenes and other Isoprenoids |
| 511-61-5 | Cyclolaudenol | NEW | Sterols, Oxygenated Terpenes and other Isoprenoids |
| 57-88-5 | Cholesterol | 100% to 160% | Sterols, Oxygenated Terpenes and other Isoprenoids |
| 59-02-9 | alpha-Tocopherol | 100% to NEW | Sterols, Oxygenated Terpenes and other Isoprenoids |
| 7616-22-0 | gamma-Tocopherol | NEW | Sterols, Oxygenated Terpenes and other Isoprenoids |
| 83-46-5 | beta-Sitosterol | 100% to 900% | Sterols, Oxygenated Terpenes and other Isoprenoids |
| 83-48-7 | Stigmasterol | 60% to 300% | Sterols, Oxygenated Terpenes and other Isoprenoids |
| 999999-99-9 | F1-U0.955 | 60% to 100% | NA |
| 999999-99-9 | F1-U1.009 | 80% to 120% | NA |
| 999999-99-9 | F1-U1.119 | 320% to 370% | NA |
| 999999-99-9 | F1-U1.216 | NEW | NA |
| 999999-99-9 | F1-U1.241 | 230% to 270% | NA |
| 999999-99-9 | F1-U1.244 | NEW | NA |
| 999999-99-9 | F1-U1.407 | 100% to 140% | NA |
| 999999-99-9 | F2-U1.407 | NEW | NA |
| 999999-99-9 | F3-U0.539 | NEW | NA |
| 999999-99-9 | F3-U0.667 | -60% to NQ | NA |
| 999999-99-9 | F3-U0.704 | NEW | NA |
| 999999-99-9 | F3-U0.736 | 150% to NEW | NA |
| 999999-99-9 | F3-U0.738 | NEW | NA |
| 999999-99-9 | F3-U0.742 | NEW | NA |
| 999999-99-9 | F3-U0.746 | NEW | NA |
| 999999-99-9 | F3-U0.75 | NEW | NA |
| 999999-99-9 | F3-U0.767 | -70% to NQ | NA |
| 999999-99-9 | F3-U0.781 | NEW | NA |

FIGURE 10-FFF

| Compound CAS# | Compound Name | Modification | Compound Class |
|---|---|---|---|
| 999999-99-9 | F3-U0.783 | NEW | NA |
| 999999-99-9 | F3-U0.79 | NEW | NA |
| 999999-99-9 | F3-U0.802 | NEW | NA |
| 999999-99-9 | F3-U0.805 | NEW | NA |
| 999999-99-9 | F3-U0.809 | NEW | NA |
| 999999-99-9 | F3-U0.821 | NQ | NA |
| 999999-99-9 | F3-U0.838 | NEW | NA |
| 999999-99-9 | F3-U0.843 | NEW | NA |
| 999999-99-9 | F3-U0.844 | NQ | NA |
| 999999-99-9 | F3-U0.848S | NEW | NA |
| 999999-99-9 | F3-U0.848R | NQ | NA |
| 999999-99-9 | F3-U0.858S | NEW | NA |
| 999999-99-9 | F3-U0.858R | NQ | NA |
| 999999-99-9 | F3-U0.866 | NEW | NA |
| 999999-99-9 | F3-U0.868 | NEW | NA |
| 999999-99-9 | F3-U0.875 | NEW | NA |
| 999999-99-9 | F3-U0.876 | 450% to NEW | NA |
| 999999-99-9 | F3-U0.882 | NEW | NA |
| 999999-99-9 | F3-U0.896 | NEW | NA |
| 999999-99-9 | F3-U0.904 | NEW | NA |
| 999999-99-9 | F3-U1.003 | NEW | NA |
| 999999-99-9 | F3-U1.076 | NEW | NA |
| 999999-99-9 | F3-U1.084 | NEW | NA |
| 999999-99-9 | F3-U1.085 | NEW | NA |
| 999999-99-9 | F3-U1.097 | NEW | NA |
| 999999-99-9 | F3-U1.120 | NEW | NA |
| 999999-99-9 | F3-U1.121 | NEW | NA |
| 999999-99-9 | F3-U1.123 | NEW | NA |
| 999999-99-9 | F3-U1.13 | NEW | NA |
| 999999-99-9 | F3-U1.136 | NEW | NA |
| 999999-99-9 | F3-U1.143 | NEW | NA |
| 999999-99-9 | F3-U1.15 | 60% to NEW | NA |
| 999999-99-9 | F3-U1.172 | NEW | NA |
| 999999-99-9 | F3-U1.189 | NEW | NA |
| 999999-99-9 | F3-U1.195 | 190% to 230% | NA |
| 999999-99-9 | F3-U1.228 | NEW | NA |

FIGURE 10-GGG

| Compound CAS# | Compound Name | Modification | | Compound Class |
|---|---|---|---|---|
| 999999-99-9 | F3-U1.229 | NEW | NA | |
| 999999-99-9 | F3-U1.23 | 540% to 580% | NA | |
| 999999-99-9 | F3-U1.232 | -60% to -90% | NA | |
| 999999-99-9 | F3-U1.253 | 90% to NEW | NA | |
| 999999-99-9 | F3-U1.254 | 130% to 180% | NA | |
| 999999-99-9 | F3-U1.255 | 100% to NEW | NA | |
| 999999-99-9 | F3-U1.256 | 60% to 100% | NA | |

FIGURE 10-HHH

A list of metabolite compounds present in altered levels relative to reference samples as chararacterized by gas chromatography and mass spectrometry. This list corresponds to samples transfected with nucleic acid sequence, Seq 34136, SEQ ID NO:316

| Compound CAS# | Compound Name | Modification | Compound Class |
|---|---|---|---|
| 28874-30-8 | 7,10,13-Docosatrienoic acid, (7Z,10Z,13Z)- | 60% to 80% | Acids - Fatty |
| 373-49-9 | 9-Hexadecenoic acid (9Z)- | 60% to 90% | Acids - Fatty |
| 57-11-4 | Octadecanoic acid | 70% to 110% | Acids - Fatty |
| 999999-99-9 | F2-U1.236 | 100% to 140% | Fatty Acid |
| 57-10-3 (RT) | Hexadecanoic acid | 5% to 11% | Acids - Fatty |
| 112-80-1 (RT) | 9-Octadecenoic acid | 31% to 105% | Acids - Fatty Unsat |
| 4706-60-9 (RT) | 7,10,13-Hexadecatrienoic acid | -99% | Acids - Fatty Unsat |

FIGURE 10-III

A list of metabolite compounds present in altered levels relative to reference samples as chararacterized by liquid chromatography. This list corresponds to samples transfected with nucleic acid sequence, Seq 34442, SEQ ID NO:317

| Compound CAS# (RT) | Compound Name | Modification | Compound Class |
|---|---|---|---|
| 56-41-7 (RT) | Alanine | 30% to 130% | Amino Acids and related Compounds |
| 56-86-0 (RT) | Glutamic Acid | 80% to 135% | Amino Acids and related Compounds |
| 63-91-2 (RT) | Phenylalanine | NEW | Amino Acids and related Compounds |

FIGURE 10-JJJ

A list of metabolite compounds present in altered levels relative to reference samples as characterized by gas and liquid chromatography and mass spectrometry. This list corresponds to samples transfected with nucleic acid sequence, Seq 37186, SEQ ID NO:318

| Compound CAS# | Compound Name | Modification | Compound Class |
|---|---|---|---|
| 999999-99-9 | Citric acid & Carbohydrate | 420% to 470% | Acid & Carbohydrate |
| 463-77-4 | Carbamic acid | 90% to 120% | Acids |
| 506-30-9 | Eicosanoic acid | 450% to 490% | Acids - Fatty |
| 57-10-3 | Hexadecanoic acid | NEW | Acids - Fatty |
| 112-80-1 (RT) | 9-Octadecenoic acid | 27% to 187% | Acids - Fatty Unsat |
| 60-33-3 (RT) | 9,12-Octadecadienoic acid | 7% to 33% | Acids - Fatty Unsat |
| 463-40-1 (RT) | 9,12,15-Octadecatrienoic acid | -3% to -9% | Acids - Fatty Unsat |
| 10191-35-2 | Butanoic acid, 2,3,4-trihydroxy- | NEW | Acids - Hydroxy |
| 88246-12-2 | Butanoic acid, 3,4-dihydroxy-, methyl ester | NEW | Acids - Hydroxy |
| 6917-35-7 | Inositol | 60% to 80% | Alcohols |
| 110-60-1 | 1,4-Butanediamine | NEW | Alkaloids and Other Bases |
| 147-85-3 | L-Proline | 270% to 310% | Amino Acids and related Compounds |
| 74-79-3 (RT) | Arginine | 40% to 690% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 71-00-1 (RT) | Histidine | NEW | Amino Acids and related Compounds |
| 61-90-5 (RT) | Leucine | NEW | Amino Acids and related Compounds |
| 63-91-2 (RT) | Phenylalanine | NEW | Amino Acids and related Compounds |
| 72-19-5 (RT) | Threonine | 25% to 275% | Amino Acids and related Compounds |
| 999999-99-9 | F3-U0.816 Carbohydrate | 90% to 180% | Carbohydrate |
| 999999-99-9 | F3-U0.826 Carbohydrate | 80% to 120% | Carbohydrate |
| 999999-99-9 | F3-U0.846 Carbohydrate | 250% to 590% | Carbohydrate |
| 999999-99-9 | F3-U0.872 Hexose | 250% to 620% | Carbohydrate |
| 50-99-7 | Glucose | 300% to 1240% | Carbohydrates |
| 57-48-7 | Fructose (chiral) | 330% to 510% | Carbohydrates |
| 999999-99-9 | F2-U1.353 Uknown 18:1 Isomer | NEW | Fatty Acid |
| 77-95-2 | Quinic acid | 100% to 140% | Phenols and Related Compounds |
| 999999-99-9 | F3-U0.736 | 80% to 360% | NA |
| 999999-99-9 | F3-U0.75 | NEW | NA |
| 999999-99-9 | F3-U0.768 | NEW | NA |
| 999999-99-9 | F3-U0.821 | 60% to 80% | NA |

FIGURE 10-KKK

| Compound CAS# | Compound Name | Modification | | Compound Class |
|---|---|---|---|---|
| 999999-99-9 | F3-U0.882 | NEW | NA | |

FIGURE 10-LLL

A list of metabolite compounds present in altered levels relative to reference samples as characterized by gas and liquid chromatography and mass spectrometry. This list corresponds to samples transfected with nucleic acid sequence, Seq 37188, SEQ ID NO:319

| Compound CAS# | Compound Name | Modification | Compound Class |
|---|---|---|---|
| 999999-99-9 | F3-U0.992 Sugar acid | NEW | Acid |
| 999999-99-9 | Citric acid & Carbohydrate | 160% to 200% | Acid & Carbohydrate |
| 327-97-9 | Chlorogenic acid | 130% to 170% | Acids |
| 6000-40-4 | Glyceric acid | NEW | Acids |
| 6915-15-7 | Malic acid | 120% to 880% | Acids |
| 7664-38-2 | Phosphoric acid | 170% to 210% | Acids |
| 77-92-9 | Citric acid | 240% to 280% | Acids |
| 112-80-1 | 9-Octadecenoic acid (9Z)- | 100% to 830% | Acids - Fatty |
| 112-85-6 | Docosanoic acid | NQ | Acids - Fatty |
| 28874-30-8 | 7,10,13-Docosatrienoic acid, (7Z,10Z,13Z)- | 60% to 70% | Acids - Fatty |
| 373-49-9 | 9-Hexadecenoic acid (9Z)- | 80% to 120% | Acids - Fatty |
| 506-30-9 | Eicosanoic acid | 80% to 120% | Acids - Fatty |
| 57-10-3 (RT) | Hexadecanoic acid | 7% to 23% | Acids - Fatty |
| 57-11-4 (RT) | Octadecanoic acid | 6% to 78% | Acids - Fatty |
| 2724-58-5 | 16-methyl-Heptadecanoic acid | 90% to 130% | Acids - Fatty Branched |
| 5918-29-6 (RT) | 14-methyl-Hexadecanoic acid | -27% to -45% | Acids - Fatty Branched |
| 4706-60-9 (RT) | 7,10,13-Hexadecatrienoic acid | 17% to 49% | Acids - Fatty Unsat |
| 60-33-3 (RT) | 9,12-Octadecadienoic acid | -13% to -39% | Acids - Fatty Unsat |
| 463-40-1 (RT) | 9,12,15-Octadecatrienoic acid | -1% to -9% | Acids - Fatty Unsat |
| 10191-35-2 | Butanoic acid, 2,3,4-trihydroxy- | 70% to 110% | Acids - Hydroxy |
| 6917-35-7 | Inositol | 100% to 200% | Alcohols |
| 147-85-3 | L-Proline | NEW | Amino Acids and related Compounds |
| 3130-87-8 | Asparagine | NEW | Amino Acids and related Compounds |
| 56-86-0 | L-Glutamic acid | NEW | Amino Acids and related Compounds |
| 6899-04-3 | Glutamine | NEW | Amino Acids and related Compounds |
| 98-79-3 | L-Proline, 5-oxo- | 130% to 170% | Amino Acids and related Compounds |
| 56-41-7 (RT) | Alanine | 25% to 240% | Amino Acids and related Compounds |
| 74-79-3 (RT) | Arginine | 45% to 650% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 71-00-1 (RT) | Histidine | NEW | Amino Acids and related Compounds |

FIGURE 10-MMM

| Compound CAS# | Compound Name | Modification | Compound Class |
|---|---|---|---|
| 73-32-5 (RT) | Isoleucine | NEW | Amino Acids and related Compounds |
| 61-90-5 (RT) | Leucine | 1000% to NEW | Amino Acids and related Compounds |
| 56-87-1 (RT) | Lysine | 50% to 725% | Amino Acids and related Compounds |
| 63-68-3 (RT) | Methionine | 155% to NEW | Amino Acids and related Compounds |
| 63-91-2 (RT) | Phenylalanine | NEW | Amino Acids and related Compounds |
| 56-45-1 (RT) | Serine | 55% to 340% | Amino Acids and related Compounds |
| 72-19-5 (RT) | Threonine | 35% to 1000% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 72-18-4 (RT) | Valine | 1450% to 4125% | Amino Acids and related Compounds |
| 999999-99-9 | F3-U0.794 | NEW | Carbohydrate |
| 999999-99-9 | F3-U0.812 | NEW | Carbohydrate |
| 999999-99-9 | F3-U0.813 | 470% to 510% | Carbohydrate |
| 999999-99-9 | F3-U0.816 Carbohydrate | 130% to 400% | Carbohydrate |
| 999999-99-9 | F3-U0.82 | 130% to 170% | Carbohydrate |
| 999999-99-9 | F3-U0.826 | 480% to 520% | Carbohydrate |
| 999999-99-9 | F3-U0.846 Carbohydrate | 300% to 470% | Carbohydrate |
| 999999-99-9 | F3-U0.872 Hexose | 300% to 1300% | Carbohydrate |
| 999999-99-9 | F3-U0.876 Hexose | 250% to NEW | Carbohydrate |
| 999999-99-9 | F3-U0.948 Hexose | 180% to NEW | Carbohydrate |
| 999999-99-9 | F3-U0.956 Hexose | NEW | Carbohydrate |
| 999999-99-9 | F3-U1.069 Carbohydrate | 180% to 220% | Carbohydrate |
| 999999-99-9 | F3-U1.104 Carbohydrate | NEW | Carbohydrate |
| 999999-99-9 | F3-U1.149 Carbohydrate | NEW | Carbohydrate |
| 999999-99-9 | F3-U1.15 | NQ | Carbohydrate |
| 999999-99-9 | F3-U1.189 Carbohydrate | 150% to 190% | Carbohydrate |
| 147-81-9 | Arabinose | NEW | Carbohydrates |
| 50-99-7 | Glucose | 100% to 5930% | Carbohydrates |
| 57-48-7 | Fructose (chiral) | 200% to 4270% | Carbohydrates |
| 57-50-1 | Sucrose | NEW | Carbohydrates |
| 999999-99-9 | F1-U1.068 Unknown Fatty Acid Ester | 80% to 120% | Fatty Acid |
| 999999-99-9 | F1-U1.076 Unknown Fatty Acid Ester | 60% to 90% | Fatty Acid |
| 999999-99-9 | F1-U1.11 Unknown Fatty Acid Ester | 60% to 80% | Fatty Acid |
| 999999-99-9 | F1-U1.113 Unknown Fatty Acid Ester | 70% to 150% | Fatty Acid |
| 999999-99-9 | F1-U1.12 Unknown Fatty Acid Ester | 90% to 200% | Fatty Acid |
| 999999-99-9 | F2-U1.21 Uknown Fatty Acid | NEW | Fatty Acid |

FIGURE 10-NNN

| Compound CAS# | Compound Name | Modification | Compound Class |
|---|---|---|---|
| 999999-99-9 | F2-U1.352 Unknown 18:1 Isomer | NQ | Fatty Acid |
| 111-02-4 | Squalene | NEW | Hydrocarbon |
| 77-95-2 | Quinic acid | 70% to 320% | Phenols and Related Compounds |
| 999999-99-9 | F1-U1.216 Unknown Sterol | NEW | Sterol |
| 14745-36-9 | alpha-Tocopherol hydroquinone | 300% to NEW | Sterols, Oxygenated Terpenes and other Isoprenoids |
| 148-03-8 | beta-Tocopherol | NEW | Sterols, Oxygenated Terpenes and other Isoprenoids |
| 20780-41-0 | Ergosta-5,24-dien-3-ol, (3b)- | -60% to -90% | Sterols, Oxygenated Terpenes and other Isoprenoids |
| 469-38-5 | Cycloartenol | 350% to NEW | Sterols, Oxygenated Terpenes and other Isoprenoids |
| 511-61-5 | Cyclolaudenol | NEW | Sterols, Oxygenated Terpenes and other Isoprenoids |
| 59-02-9 | alpha-Tocopherol | 1000% to NEW | Sterols, Oxygenated Terpenes and other Isoprenoids |
| 83-46-5 | beta-Sitosterol | 100% to 130% | Sterols, Oxygenated Terpenes and other Isoprenoids |
| 83-48-7 | Stigmasterol | 60% to 90% | Sterols, Oxygenated Terpenes and other Isoprenoids |
| 999999-99-9 | F1-U0.871 | NEW | NA |
| 999999-99-9 | F1-U0.875 | NEW | NA |
| 999999-99-9 | F3-U0.552 | NEW | NA |
| 999999-99-9 | F3-U0.736 | 200% to 240% | NA |
| 999999-99-9 | F3-U0.75 | NEW | NA |
| 999999-99-9 | F3-U0.768 | -60% to -80% | NA |
| 999999-99-9 | F3-U0.783 | NEW | NA |
| 999999-99-9 | F3-U0.838 | NEW | NA |
| 999999-99-9 | F3-U0.844 | 400% to 440% | NA |
| 999999-99-9 | F3-U0.852 | NEW | NA |
| 999999-99-9 | F3-U0.866 | NEW | NA |
| 999999-99-9 | F3-U0.868 | NEW | NA |
| 999999-99-9 | F3-U0.882 | 60% to 80% | NA |
| 999999-99-9 | F3-U0.899 | NEW | NA |
| 999999-99-9 | F3-U0.902 | 100% to 180% | NA |
| 999999-99-9 | F3-U1.037 | NEW | NA |
| 999999-99-9 | F3-U1.113 | NEW | NA |
| 999999-99-9 | F3-U1.12 | NEW | NA |
| 999999-99-9 | F3-U1.142 | NEW | NA |
| 999999-99-9 | F3-U1.194 | 120% to 160% | NA |
| 999999-99-9 | F3-U1.229 | -60% to 80% | NA |
| 999999-99-9 | F3-U1.258 | -60% to -90% | NA |
| 999999-99-9 | F3-U1.272 | NEW | NA |

FIGURE 10-OOO

A list of metabolite compounds present in altered levels relative to reference samples as chararacterized by gas and liquid chromatography and mass spectrometry. This list corresponds to samples transfected with nucleic acid sequence, Seq 38919, SEQ ID NO:320

| Compound CAS# | Compound Name | Modification | Compound Class |
|---|---|---|---|
| 56-41-7 (RT) | Alanine | 35% to 180% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 71-00-1 (RT) | Histidine | NEW | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 56-87-1 (RT) | Lysine | 400% to 1075% | Amino Acids and related Compounds |
| 63-91-2 (RT) | Phenylalanine | NEW | Amino Acids and related Compounds |
| 56-45-1 (RT) | Serine | 40% to 135% | Amino Acids and related Compounds |
| 72-19-5 (RT) | Threonine | 25% to 120% | Amino Acids and related Compounds |
| 73-22-3 (RT) | Tryptophane | NEW | Amino Acids and related Compounds |
| 60-18-4 (RT) | Tyrosine | 140% to 270% | Amino Acids and related Compounds |
| 72-18-4 (RT) | Valine | 15% to 390% | Amino Acids and related Compounds |
| 111-02-4 | Squalene | NEW | Hydrocarbon |
| 1176-52-9 | Lophenol, 24-methylene- | 100% to 160% | Sterols, Oxygenated Terpenes and other Isoprenoids |
| 14745-36-9 | alpha-Tocopherol hydroquinone | 60% to 110% | Sterols, Oxygenated Terpenes and other Isoprenoids |
| 16910-32-0 | Obtusifoliol | 80% to 120% | Sterols, Oxygenated Terpenes and other Isoprenoids |
| 59-02-9 | alpha-Tocopherol | 140% to 270% | Sterols, Oxygenated Terpenes and other Isoprenoids |
| 7616-22-0 | gamma-Tocopherol | NEW | Sterols, Oxygenated Terpenes and other Isoprenoids |
| 83-46-5 | beta-Sitosterol | 60% to 90% | Sterols, Oxygenated Terpenes and other Isoprenoids |
| 999999-99-9 | F1-U1.243 | 80% to 120% | NA |
| 999999-99-9 | F1-U1.247 | NEW | NA |

FIGURE 10-PPP

A list of metabolite compounds present in altered levels relative to reference samples as chararacterized by gas and liquid chromatography and mass spectrometry. This list corresponds to samples transfected with nucleic acid sequence, Seq 45801, SEQ ID NO:321

| Compound CAS# | Compound Name | Modification | Compound Class |
|---|---|---|---|
| 999999-99-9 | Citric acid & Carbohydrate | 110% to 160% | Acid & Carbohydrate |
| 6000-40-4 | Glyceric acid | NEW | Acids |
| 77-92-9 | Citric acid | 80% to 120% | Acids |
| 112-80-1 | 9-Octadecenoic acid (9Z)- | 60% to 90% | Acids - Fatty |
| 112-85-6 | Docosanoic acid | NQ | Acids - Fatty |
| 373-49-9 | 9-Hexadecenoic acid (9Z)- | -60% to -90% | Acids - Fatty |
| 57-10-3 (RT) | Hexadecanoic acid | 3% to 21% | Acids - Fatty |
| 57-11-4 (RT) | Octadecanoic acid | 31% to 65% | Acids - Fatty |
| 506-30-9 (RT) | Eicosanoic acid | 7% to 125% | Acids - Fatty |
| 6250-72-2 | 16-methyl-Heptadecanoic acid | 160% to 200% | Acids - Fatty Branched |
| 5918-29-6 (RT) | 14-methyl-Hexadecanoic acid | -23% to -43% | Acids - Fatty Branched |
| 463-40-1 | 9,12,15-Octadecatrienoic acid (9Z,12Z,15Z)- | NQ | Acids - Fatty Unsat |
| 60-33-3 (RT) | 9,12-Octadecadienoic acid | -13% to -31% | Acids - Fatty Unsat |
| 10191-35-2 | Butanoic acid, 2,3,4-trihydroxy- | 170% to 210% | Acids - Hydroxy |
| 6915-15-7 | Malic acid | 60% to 140% | Acids - Hydroxy Alpha |
| 999999-99-9 | F3-U0.784 Sugar alcohol | NEW | Alcohol |
| 147-85-3 | L-Proline | 60% to 140% | Amino Acids and related Compounds |
| 56-86-0 | L-Glutamic acid | NEW | Amino Acids and related Compounds |
| 6899-04-3 | Glutamine | NEW | Amino Acids and related Compounds |
| 98-79-3 | L-Proline, 5-oxo- | 60% to 80% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 63-68-3 (RT) | Methionine | NEW | Amino Acids and related Compounds |
| 72-19-5 (RT) | Threonine | 95% to 170% | Amino Acids and related Compounds |
| 60-18-4 (RT) | Tyrosine | NEW | Amino Acids and related Compounds |
| 999999-99-9 | F3-U0.813 Carbohydrate | 140% to 180% | Carbohydrate |
| 999999-99-9 | F3-U0.815 Carbohydrate | 80% to 120% | Carbohydrate |
| 999999-99-9 | F3-U0.816 Carbohydrate | 60% to 100% | Carbohydrate |
| 999999-99-9 | F3-U0.825 | 60% to 90% | Carbohydrate |
| 999999-99-9 | F3-U0.826 Carbohydrate | 150% to 190% | Carbohydrate |
| 999999-99-9 | F3-U0.846 Carbohydrate | 60% to 260% | Carbohydrate |
| 999999-99-9 | F3-U0.872 Hexose | 200% to 280% | Carbohydrate |
| 999999-99-9 | F3-U0.956 Hexose | NEW | Carbohydrate |

FIGURE 10-QQQ

| Compound CAS# | Compound Name | Modification | Compound Class |
|---|---|---|---|
| 999999-99-9 | F3-U1.113 Carbohydrate | NEW | Carbohydrate |
| 50-99-7 | Glucose | 130% to 800% | Carbohydrates |
| 57-48-7 | Fructose (chiral) | 500% to 600% | Carbohydrates |
| 999999-99-9 | F1-U1.068 Unknown Fatty Acid Ester | 80% to 120% | Fatty Acid |
| 999999-99-9 | F1-U1.112 Unknown Fatty Acid Ester | 60% to 100% | Fatty Acid |
| 999999-99-9 | F1-U1.114 Unknown Fatty Acid Ester | 110% to 150% | Fatty Acid |
| 999999-99-9 | F1-U1.121 Unknown Fatty Acid Ester | 110% to 150% | Fatty Acid |
| 999999-99-9 | F2-U1.352 Unknown 18:1 Isomer | NQ | Fatty Acid |
| 77-95-2 | Quinic acid | 60% to 100% | Phenols and Related Compounds |
| 13190-97-1 | Solanesol | 100% to NEW | Sterols, Oxygenated Terpenes and other Isoprenoids |
| 148-03-8 | beta-Tocopherol | NEW | Sterols, Oxygenated Terpenes and other Isoprenoids |
| 469-38-5 | Cycloartenol | 410% to NEW | Sterols, Oxygenated Terpenes and other Isoprenoids |
| 474-62-4 | Campesterol | 80% to 120% | Sterols, Oxygenated Terpenes and other Isoprenoids |
| 57-88-5 | Cholesterol | 130% to 170% | Sterols, Oxygenated Terpenes and other Isoprenoids |
| 83-46-5 | beta-Sitosterol | 60% to 160% | Sterols, Oxygenated Terpenes and other Isoprenoids |
| 83-48-7 | Stigmasterol | 60% to 80% | Sterols, Oxygenated Terpenes and other Isoprenoids |
| 999999-99-9 | F3-U0.736 | -60% to NQ | NA |
| 999999-99-9 | F3-U0.767 | NQ | NA |
| 999999-99-9 | F3-U0.783 | NEW | NA |
| 999999-99-9 | F3-U0.838 | NEW | NA |
| 999999-99-9 | F3-U0.842 | NEW | NA |
| 999999-99-9 | F3-U0.843 | NEW | NA |
| 999999-99-9 | F3-U0.882 | 160% to 200% | NA |
| 999999-99-9 | F3-U0.903 | 80% to 120% | NA |
| 999999-99-9 | F3-U1.229 | -60% to -90% | NA |

FIGURE 10-RRR

A list of metabolite compounds present in altered levels relative to reference samples as chararacterized by gas chromatography. This list corresponds to samples transfected with nucleic acid sequence, Seq 45804, SEQ ID NO:322

| Compound CAS# | Compound Name | Modification | Compound Class |
|---|---|---|---|
| 57-10-3 (RT) | Hexadecanoic acid | 5% to 12% | Acids - Fatty |
| 57-11-4 (RT) | Octadecanoic acid | 43% to 61% | Acids - Fatty |
| 463-40-1 (RT) | 9,12,15-Octadecatrienoic acid | -3% to -7% | Acids - Fatty Unsat |

FIGURE 10-SSS

A list of metabolite compounds present in altered levels relative to reference samples as characterized by gas and liquid chromatography and mass spectrometry. This list corresponds to samples transfected with nucleic acid sequence, Seq 45808, SEQ ID NO:323

| Compound CAS# | Compound Name | Modification | Compound Class |
|---|---|---|---|
| 327-97-9 | Chlorogenic acid | 100% to 140% | Acids |
| 6915-15-7 | Malic acid | 970% to 1000% | Acids |
| 77-92-9 | Citric acid | 80% to 120% | Acids |
| 112-80-1 (RT) | 9-Octadecenoic acid | 25% to 105% | Acids - Fatty Unsat |
| 60-33-3 (RT) | 9,12-Octadecadienoic acid | -9% to -25% | Acids - Fatty Unsat |
| 463-40-1 (RT) | 9,12,15-Octadecatrienoic acid | 1% to 3% | Acids - Fatty Unsat |
| 88246-12-2 | Butanoic acid, 3,4-dihydroxy-, methyl ester | NEW | Acids - Hydroxy |
| 6917-35-7 | Inositol | 100% to 160% | Alcohols |
| 147-85-3 | L-Proline | NEW | Amino Acids and related Compounds |
| 1825-94-2 | Glutamine | NEW | Amino Acids and related Compounds |
| 3130-87-8 | Asparagine | NEW | Amino Acids and related Compounds |
| 56-41-7 (RT) | Alanine | 35% to 225% | Amino Acids and related Compounds |
| 71-00-1 (RT) | Histidine | NEW | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 56-87-1 (RT) | Lysine | 15% to 375% | Amino Acids and related Compounds |
| 63-68-3 (RT) | Methionine | NEW | Amino Acids and related Compounds |
| 63-91-2 (RT) | Phenylalanine | NEW | Amino Acids and related Compounds |
| 56-45-1 (RT) | Serine | 40% to 515% | Amino Acids and related Compounds |
| 72-19-5 (RT) | Threonine | 185% to 740% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 999999-99-9 | F3-U0.872S Hexose | 130% to 190% | Carbohydrate |
| 999999-99-9 | F3-U1.149 Carbohydrate | 200% to 270% | Carbohydrate |
| 999999-99-9 | F3-U0.794 | NEW | Carbohydrate |
| 999999-99-9 | F3-U0.848S Carbohydrate | NEW | Carbohydrate |
| 999999-99-9 | F3-U0.876 Hexose | NEW | Carbohydrate |
| 999999-99-9 | F3-U1.113 Carbohydrate | NEW | Carbohydrate |
| 999999-99-9 | F3-U1.189 Carbohydrate | 160% to 200% | Carbohydrate |
| 50-99-7 | Glucose | 3000% to 6000% | Carbohydrates |
| 57-48-7 | Fructose (chiral) | 2100% to 3300% | Carbohydrates |
| 57-50-1 | Sucrose | NEW | Carbohydrates |
| 999999-99-9 | Unknown Fatty Acid Ester | 150% to 300% | Fatty Acid |
| 1560-72-1 | Triacontane, 2-methyl- | 60% to 90% | Hydrocarbon |

FIGURE 10-TTT

| Compound CAS# | Compound Name | Modification | Compound Class |
|---|---|---|---|
| 77-95-2 | Quinic acid | 200% to 430% | Phenols and Related Compounds |
| 999999-99-9 | Unknown Sterol | NEW | Sterol |
| 14745-36-9 | alpha-Tocopherol hydroquinone | 600% to 660% | Sterols, Oxygenated Terpenes and other Isoprenoids |
| 469-38-5 | Cycloartenol | 230% to 280% | Sterols, Oxygenated Terpenes and other Isoprenoids |
| 474-62-4 | Campesterol | 150% to 200% | Sterols, Oxygenated Terpenes and other Isoprenoids |
| 57-88-5 | Cholesterol | 60% to 100% | Sterols, Oxygenated Terpenes and other Isoprenoids |
| 59-02-9 | alpha-Tocopherol | 250% to 300% | Sterols, Oxygenated Terpenes and other Isoprenoids |
| 7616-22-0 | gamma-Tocopherol | NEW | Sterols, Oxygenated Terpenes and other Isoprenoids |
| 83-46-5 | beta-Sitosterol | 130% to 180% | Sterols, Oxygenated Terpenes and other Isoprenoids |
| 83-48-7 | Stigmasterol | 80% to 120% | Sterols, Oxygenated Terpenes and other Isoprenoids |
| 2277-28-3 | 9,12-Octadecadienoic acid (Z,Z)-, 2,3-dihydroxypropyl ester | 170% to 210% | Glycerides |
| 999999-99-9 | F3-U0.552 | NEW | NA |
| 999999-99-9 | F3-U0.783 | NEW | NA |
| 999999-99-9 | F3-U0.882 | 1370% to 1410% | NA |
| 999999-99-9 | F3-U0.903 | 120% to 180% | NA |

FIGURE 10-UUU

A list of metabolite compounds present in altered levels relative to reference samples as chararacterized by gas and liquid chromatography and mass spectrometry. This list corresponds to samples transfected with nucleic acid sequence, Seq 45820, SEQ ID NO:324

| Compound CAS# | Compound Name | Modification | Compound Class |
|---|---|---|---|
| 999999-99-9 | Citric acid & Carbohydrate | -60% to -90% | Acid & Carbohydrate |
| 327-97-9 | Chlorogenic acid | 60% to 100% | Acids |
| 463-77-4 | Carbamic acid | 210% to 250% | Acids |
| 6000-40-4 | Glyceric acid | NEW | Acids |
| 6915-15-7 | Malic acid | 400% to 440% | Acids |
| 7664-38-2 | Phosphoric acid | 60% to 80% | Acids |
| 6917-35-7 | Inositol | 80% to 120% | Alcohols |
| 147-85-3 | L-Proline | 70% to 120% | Amino Acids and related Compounds |
| 3130-87-8 | Asparagine | NEW | Amino Acids and related Compounds |
| 56-40-6 | Glycine | NEW | Amino Acids and related Compounds |
| 56-84-8 | L-Aspartic acid | NEW | Amino Acids and related Compounds |
| 56-86-0 | L-Glutamic acid | NEW | Amino Acids and related Compounds |
| 6899-04-3 | Glutamine | NEW | Amino Acids and related Compounds |
| 70-47-3 | L-Asparagine | NEW | Amino Acids and related Compounds |
| 98-79-3 | L-Proline, 5-oxo- | 80% to 120% | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 72-19-5 (RT) | Threonine | 80% to 435% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 57-50-1 | Sucrose | NEW | Carbohydrate |
| 999999-99-9 | F3-U0.794 | NEW | Carbohydrate |
| 999999-99-9 | F3-U0.812 | NEW | Carbohydrate |
| 999999-99-9 | F3-U0.813 Carbohydrate | NQ | Carbohydrate |
| 999999-99-9 | F3-U0.815 | NEW | Carbohydrate |
| 999999-99-9 | F3-U0.816 Carbohydrate | NQ | Carbohydrate |
| 999999-99-9 | F3-U0.845 Carbohydrate | 90% to 580% | Carbohydrate |
| 999999-99-9 | F3-U0.846 Carbohydrate | -70% to -110% | Carbohydrate |
| 999999-99-9 | F3-U0.872 Hexose | 110% to 800% | Carbohydrate |
| 999999-99-9 | F3-U0.876 Hexose | NEW | Carbohydrate |
| 999999-99-9 | F3-U0.882 Hexose | 100% to 830% | Carbohydrate |
| 999999-99-9 | F3-U0.956 Hexose | NEW | Carbohydrate |
| 999999-99-9 | F3-U1.104 Carbohydrate | NEW | Carbohydrate |
| 999999-99-9 | F3-U1.119 Carbohydrate | NEW | Carbohydrate |

FIGURE 10-VVV

| Compound CAS# | Compound Name | Modification | Compound Class |
|---|---|---|---|
| 999999-99-9 | F3-U1.15 | 60% to 80% | Carbohydrate |
| 999999-99-9 | F3-U1.189 Carbohydrate | 80% to 130% | Carbohydrate |
| 50-99-7 | Glucose | 200% to 3690% | Carbohydrates |
| 57-48-7 | Fructose (chiral) | 100% to 1140% | Carbohydrates |
| 77-95-2 | Quinic acid | 150% to 170% | Phenols and Related Compounds |
| 999999-99-9 | F3-U0.713 | NQ | NA |
| 999999-99-9 | F3-U0.716 | NEW | NA |
| 999999-99-9 | F3-U0.783 | NEW | NA |
| 999999-99-9 | F3-U0.866 | NEW | NA |
| 999999-99-9 | F3-U0.902 | 80% to 110% | NA |
| 999999-99-9 | F3-U1.12 | NEW | NA |
| 999999-99-9 | F3-U1.228 | NEW | NA |
| 999999-99-9 | F3-U1.253 | 150% to 190% | NA |
| 999999-99-9 | F3-U1.255 | 120% to 160% | NA |

FIGURE 10-WWW

A list of metabolite compounds present in altered levels relative to reference samples as chararacterized by liquid chromatography. This list corresponds to samples transfected with nucleic acid sequence, Seq 45850, SEQ ID NO:326

| Compound CAS# | Compound Name | Modification | Compound Class |
|---|---|---|---|
| 56-41-7 (RT) | Alanine | -50% to -60% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 73-32-5 (RT) | Isoleucine | NEW | Amino Acids and related Compounds |
| 56-87-1 (RT) | Lysine | 565% to 1475% | Amino Acids and related Compounds |
| 63-68-3 (RT) | Methionine | 290% to 410% | Amino Acids and related Compounds |
| 63-91-2 (RT) | Phenylalanine | NEW | Amino Acids and related Compounds |
| 72-19-5 (RT) | Threonine | 210% to 420% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 72-18-4 (RT) | Valine | 255% to 575% | Amino Acids and related Compounds |

FIGURE 10-XXX

A list of metabolite compounds present in altered levels relative to reference samples as chararacterized by liquid chromatography. This list corresponds to samples transfected with nucleic acid sequence, Seq 45853, SEQ ID NO:327

| Compound CAS# | Compound Name | Modification | Compound Class |
|---|---|---|---|
| 74-79-3 (RT) | Arginine | 5% to 500% | Amino Acids and related Compounds |

FIGURE 10-YYY

A list of metabolite compounds present in altered levels relative to reference samples as chararacterized by gas and liquid chromatography and mass spectrometry. This list corresponds to samples transfected with nucleic acid sequence, Seq 45855, SEQ ID NO:328

| Compound CAS# | Compound Name | Modification | Compound Class |
|---|---|---|---|
| 327-97-9 | Chlorogenic acid | 420% to NEW | Acids |
| 463-77-4 | Carbamic acid | -70% to NQ | Acids |
| 6000-40-4 | Glyceric acid | NEW | Acids |
| 6915-15-7 | Malic acid | -70% to -80% | Acids |
| 7664-38-2 | Phosphoric acid | 70% to 130% | Acids |
| 6917-35-7 | Inositol | 80% to 120% | Alcohols |
| 147-85-3 | L-Proline | 150% to 190% | Amino Acids and related Compounds |
| 56-40-6 | Glycine | NEW | Amino Acids and related Compounds |
| 56-84-8 | L-Aspartic acid | NEW | Amino Acids and related Compounds |
| 56-86-0 | L-Glutamic acid | NEW | Amino Acids and related Compounds |
| 6899-04-3 | Glutamine | NEW | Amino Acids and related Compounds |
| 98-79-3 | L-Proline, 5-oxo- | 80% to 270% | Amino Acids and related Compounds |
| 74-79-3 (RT) | Arginine | 125% to 1065% | Amino Acids and related Compounds |
| 56-89-3 (RT) | Cysteine | NEW | Amino Acids and related Compounds |
| 71-00-1 (RT) | Histidine | NEW | Amino Acids and related Compounds |
| 73-32-5 (RT) | Isoleucine | NEW | Amino Acids and related Compounds |
| 61-90-5 (RT) | Leucine | 110% to NEW | Amino Acids and related Compounds |
| 56-87-1 (RT) | Lysine | 120% to 1275% | Amino Acids and related Compounds |
| 63-68-3 (RT) | Methionine | 65% to NEW | Amino Acids and related Compounds |
| 63-91-2 (RT) | Phenylalanine | NEW | Amino Acids and related Compounds |
| 56-45-1 (RT) | Serine | 55% to 220% | Amino Acids and related Compounds |
| 72-19-5 (RT) | Threonine | 65% to 610% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 72-18-4 (RT) | Valine | 220% to 1925% | Amino Acids and related Compounds |
| 999999-99-9 | F3-U0.794 Carbohydrate | NEW | Carbohydrate |
| 999999-99-9 | F3-U0.825 | NQ | Carbohydrate |
| 999999-99-9 | F3-U0.845 | -60% to -90% | Carbohydrate |
| 999999-99-9 | F3-U0.846 Carbohydrate | 80% to 420% | Carbohydrate |
| 999999-99-9 | F3-U0.872 Hexose | 160% to 470% | Carbohydrate |
| 999999-99-9 | F3-U0.876 Hexose | NEW | Carbohydrate |
| 999999-99-9 | F3-U0.948 Carbohydrate | 150% to NEW | Carbohydrate |

FIGURE 10-ZZZ

| Compound CAS# | Compound Name | | Modification | | Compound Class |
|---|---|---|---|---|---|
| 999999-99-9 | F3-U1.069 | Carbohydrate | 180% to 220% | | Carbohydrate |
| 999999-99-9 | F3-U1.104 | Carbohydrate | NEW | | Carbohydrate |
| 999999-99-9 | F3-U1.112 | Carbohydrate | NQ | | Carbohydrate |
| 999999-99-9 | F3-U1.149 | Carbohydrate | 70% to 110% | | Carbohydrate |
| 999999-99-9 | F3-U1.194 | Carbohydrate | 80% to 100% | | Carbohydrate |
| 26566-61-0 | Galactose | | 1580% to 3390% | | Carbohydrates |
| 50-99-7 | Glucose | | 110% to 1300% | | Carbohydrates |
| 57-48-7 | Fructose (chiral) | | 170% to 2620% | | Carbohydrates |
| 57-50-1 | Sucrose | | NEW | | Carbohydrates |
| 609-06-3 | L-Xylose | | NEW | | Carbohydrates |
| 999999-99-9 | F3-U0.816 | Carbohydrate | 90% to 440% | | Carbohydrates |
| 999999-99-9 | F3-U0.821 | Carbohydrate | 360% to 400% | | Carbohydrates |
| 999999-99-9 | F3-U0.826 | Carbohydrate | 350% to 390% | | Carbohydrates |
| 999999-99-9 | F3-U0.952 | Hexose | NEW | | Carbohydrates |
| 138-59-0 | Shikimic acid | | NEW | | Phenols and Related Compounds |
| 77-95-2 | Quinic acid | | 240% to 280% | | Phenols and Related Compounds |
| 99-96-7 | Benzoic acid, 4-hydroxy- | | -60% to -80% | | Phenols and Related Compounds |
| 999999-99-9 | F3-0.839 | | NEW | | NA |
| 999999-99-9 | F3-U0.668 | | -60% to -80% | | NA |
| 999999-99-9 | F3-U0.737 | | 210% to 250% | | NA |
| 999999-99-9 | F3-U0.751 | | -70% to -90% | | NA |
| 999999-99-9 | F3-U0.768 | | NEW | | NA |
| 999999-99-9 | F3-U0.783 | | NEW | | NA |
| 999999-99-9 | F3-U0.843 | | NEW | | NA |
| 999999-99-9 | F3-U0.846 | | 1157.00% | | NA |
| 999999-99-9 | F3-U0.852 | | NQ | | NA |
| 999999-99-9 | F3-U0.853 | | NEW | | NA |
| 999999-99-9 | F3-U0.857 | | NQ | | NA |
| 999999-99-9 | F3-U0.882 | | 90% to NEW | | NA |
| 999999-99-9 | F3-U0.903 | | 90% to 130% | | NA |
| 999999-99-9 | F3-U1.113 | | NEW | | NA |
| 999999-99-9 | F3-U1.189 | | 100% to NEW | | NA |
| 999999-99-9 | F3-U1.23 | | 80% to 120% | | NA |
| 999999-99-9 | F3-U1.253 | | 70% to 110% | | NA |
| 999999-99-9 | F3-U1.254 | | 70% to 110% | | NA |

FIGURE 10-AAAA

A list of metabolite compounds present in altered levels relative to reference samples as chararacterized by gas and liquid chromatography and mass spectrometry. This list corresponds to samples transfected with nucleic acid sequence, Seq 45864, SEQ ID NO:329

| Compound CAS# | Compound Name | Modification | Compound Class |
|---|---|---|---|
| 327-97-9 | Chlorogenic acid | 60% to 80% | Acids |
| 463-77-4 | Carbamic acid | -60% to -90% | Acids |
| 6000-40-4 | Glyceric acid | 1000% to NEW | Acids |
| 6915-15-7 | Malic acid | 70% to 200% | Acids |
| 7664-38-2 | Phosphoric acid | 60% to 80% | Acids |
| 77-92-9 | Citric acid | -60% to NQ | Acids |
| 6917-35-7 | Inositol | 70% to 110% | Alcohols |
| 6899-04-3 | Glutamine | NEW | Amino Acids and related Compounds |
| 3130-87-8 | Asparagine | NEW | Amino Acids and related Compounds |
| 56-40-6 | Glycine | NEW | Amino Acids and related Compounds |
| 56-86-0 | L-Glutamic acid | NEW | Amino Acids and related Compounds |
| 98-79-3 | L-Proline, 5-oxo- | 60% to 100% | Amino Acids and related Compounds |
| 56-89-3 (RT) | Cysteine | NEW | Amino Acids and related Compounds |
| 56-40-6 (RT) | Glycine | NEW | Amino Acids and related Compounds |
| 61-90-5 (RT) | Leucine | 35% to 320% | Amino Acids and related Compounds |
| 63-68-3 (RT) | Methionine | NEW | Amino Acids and related Compounds |
| 63-91-2 (RT) | Phenylalanine | NEW | Amino Acids and related Compounds |
| 147-85-3 (RT) | Proline | -225% to -490% | Amino Acids and related Compounds |
| 56-45-1 (RT) | Serine | 110% to 200% | Amino Acids and related Compounds |
| 72-19-5 (RT) | Threonine | 30% to 270% | Amino Acids and related Compounds |
| 60-18-4 (RT) | Tyrosine | NEW | Amino Acids and related Compounds |
| 72-18-4 (RT) | Valine | 125% to 550% | Amino Acids and related Compounds |
| 999999-99-9 | F3-U0.794 | NEW | Carbohydrate |
| 999999-99-9 | F3-U0.845 | 320% to 370% | Carbohydrate |
| 999999-99-9 | F3-U0.846 Carbohydrate | 180% to 400% | Carbohydrate |
| 999999-99-9 | F3-U0.872S Hexose | 210% to NEW | Carbohydrate |
| 999999-99-9 | F3-U0.876 Hexose | NEW | Carbohydrate |
| 999999-99-9 | F3-U0.948 Hexose | NEW | Carbohydrate |
| 999999-99-9 | F3-U0.952 Hexose | NEW | Carbohydrate |
| 999999-99-9 | F3-U1.104 Carbohydrate | NEW | Carbohydrate |
| 999999-99-9 | F3-U1.113 Carbohydrate | 100% to NEW | Carbohydrate |

FIGURE 10-BBBB

| Compound CAS# | Compound Name | Modification | Compound Class |
|---|---|---|---|
| 999999-99-9 | F3-U1.150 Carbohydrate | 100% to 140% | Carbohydrate |
| 999999-99-9 | F3-U1.189 Carbohydrate | 70% to 130% | Carbohydrate |
| 999999-99-9 | F3-U1.194 Carbohydrate | 80% to 130% | Carbohydrate |
| 50-99-7 | Glucose | 400% to 4000% | Carbohydrates |
| 57-48-7 | Fructose (chiral) | 300% to 3500% | Carbohydrates |
| 999999-99-9 | F1-U1.065 Unknown Fatty Acid Ester | 80% to 120% | Fatty Acid |
| 999999-99-9 | F1-U1.068 Unknown Fatty Acid Ester | 60% to 110% | Fatty Acid |
| 999999-99-9 | F1-U1.076 Unknown Fatty Acid Ester | 150% to 200% | Fatty Acid |
| 999999-99-9 | F1-U1.11 Unknown Fatty Acid Ester | 60% to 110% | Fatty Acid |
| 999999-99-9 | F1-U1.113 Unknown Fatty Acid Ester | NEW | Fatty Acid |
| 999999-99-9 | F1-U1.114 Unknown Fatty Acid Ester | 80% to 120% | Fatty Acid |
| 999999-99-9 | F1-U1.12 Unknown Fatty Acid Ester | 120% to 170% | Fatty Acid |
| 999999-99-9 | F1-U1.121 Unknown Fatty Acid Ester | 60% to 100% | Fatty Acid |
| 77-95-2 | Quinic acid | 300% to 350% | Phenols and Related Compounds |
| 13190-97-1 | Solanesol | NEW | Sterols, Oxygenated Terpenes and other Isoprenoids |
| 14745-36-9 | alpha-Tocopherol hydroquinone | 400% to NEW | Sterols, Oxygenated Terpenes and other Isoprenoids |
| 469-38-5 | Cycloartenol | NQ | Sterols, Oxygenated Terpenes and other Isoprenoids |
| 474-62-4 | Campesterol | 100% to 150% | Sterols, Oxygenated Terpenes and other Isoprenoids |
| 57-88-5 | Cholesterol | 60% to 90% | Sterols, Oxygenated Terpenes and other Isoprenoids |
| 59-02-9 | alpha-Tocopherol | 250% to NEW | Sterols, Oxygenated Terpenes and other Isoprenoids |
| 83-46-5 | beta-Sitosterol | 120% to 170% | Sterols, Oxygenated Terpenes and other Isoprenoids |
| 83-48-7 | Stigmasterol | 60% to 90% | Sterols, Oxygenated Terpenes and other Isoprenoids |
| 999999-99-9 | F3-U0.556 | -60% to -80% | NA |
| 999999-99-9 | F3-U0.599 | NEW | NA |
| 999999-99-9 | F3-U0.713 | -70% to NQ | NA |
| 999999-99-9 | F3-U0.717 | NEW | NA |
| 999999-99-9 | F3-U0.781 | NEW | NA |
| 999999-99-9 | F3-U0.813 | 170% to 210% | NA |
| 999999-99-9 | F3-U0.816 | 60% to 100% | NA |
| 999999-99-9 | F3-U0.843 | NEW | NA |
| 999999-99-9 | F3-U0.844 | NQ | NA |
| 999999-99-9 | F3-U0.848 | NEW | NA |
| 999999-99-9 | F3-U0.858R | NQ | NA |

FIGURE 10-CCCC

| Compound CAS# | Compound Name | Modification | | Compound Class |
|---|---|---|---|---|
| 999999-99-9 | F3-U0.868 | NEW | NA | |
| 999999-99-9 | F3-U0.875 | NEW | NA | |
| 999999-99-9 | F3-U0.875R | NQ | NA | |
| 999999-99-9 | F3-U0.881 | NEW | NA | |
| 999999-99-9 | F3-U0.882 | 200% to 600% | NA | |
| 999999-99-9 | F3-U0.897 | NEW | NA | |
| 999999-99-9 | F3-U0.899 | NEW | NA | |
| 999999-99-9 | F3-U0.902 | 60% to 80% | NA | |
| 999999-99-9 | F3-U0.903 | 220% to 280% | NA | |
| 999999-99-9 | F3-U1.037 | NEW | NA | |
| 999999-99-9 | F3-U1.229 | 80% to 120% | NA | |
| 999999-99-9 | F3-U1.232 | 60% to 80% | NA | |
| 999999-99-9 | F3-U1.253 | 120% to 170% | NA | |
| 999999-99-9 | F3-U1.254 | 140% to 180% | NA | |
| 999999-99-9 | F3-U1.255 | 130% to 170% | NA | |
| 999999-99-9 | F3-U1.256 | 180% to 220% | NA | |

FIGURE 10-DDDD

A list of metabolite compounds present in altered levels relative to reference samples as chararacterized by liquid chromatography. This list corresponds to samples transfected with nucleic acid sequence, Seq 45866, SEQ ID NO:330

| Compound CAS# | Compound Name | Modification | Compound Class |
|---|---|---|---|
| 56-41-7 (RT) | Alanine | 25% to 235% | Amino Acids and related Compounds |
| 74-79-3 (RT) | Arginine | 15% to 560% | Amino Acids and related Compounds |
| 73-32-5 (RT) | Isoleucine | NEW | Amino Acids and related Compounds |
| 61-90-5 (RT) | Leucine | NEW | Amino Acids and related Compounds |
| 56-87-1 (RT) | Lysine | 480% to 1270% | Amino Acids and related Compounds |
| 63-68-3 (RT) | Methionine | 230% to 330% | Amino Acids and related Compounds |
| 63-91-2 (RT) | Phenylalanine | NEW | Amino Acids and related Compounds |
| 56-45-1 (RT) | Serine | 20% to 165% | Amino Acids and related Compounds |
| 72-19-5 (RT) | Threonine | 25% to 265% | Amino Acids and related Compounds |
| 73-22-3 (RT) | Tryptophane | NEW | Amino Acids and related Compounds |
| 60-18-4 (RT) | Tyrosine | NEW | Amino Acids and related Compounds |
| 72-18-4 (RT) | Valine | 300% to 650% | Amino Acids and related Compounds |

FIGURE 10-EEEE

A list of metabolite compounds present in altered levels relative to reference samples as chararacterized by gas chromatography and mass spectrometry. This list corresponds to samples transfected with nucleic acid sequence, Seq 56465, SEQ ID NO:333

| Compound CAS# | Compound Name | Modification | Compound Class |
|---|---|---|---|
| 999999-99-9 | F1-U1.11 Unknown Fatty Acid Ester | 80% to 130% | Fatty Acid |
| 999999-99-9 | F1-U1.119 Unknown Fatty Acid Ester | 60% to 90% | Fatty Acid |
| 102608-53-7 | 1-Hexadecen-2-ol, 3,7,11,15-tetramethyl- | 90% to 140% | Fatty Acid |
| 23470-00-0 | Glyceryl palmitate | 60% to 100% | Glycerides |
| 55268-58-1 | 9,12,15-Octadecatrienoic acid, glyceryl ester (9Z,12Z,15Z) | NEW | Glycerides |
| 1560-72-1 | Triacontane, 2-methyl- | 60% to 90% | Hydrocarbon |
| 999999-99-9 | Sterol | NEW | Sterol |
| 474-62-4 | Campesterol | 60% to 90% | Sterols, Oxygenated Terpenes and other Isoprenoids |
| 83-46-5 | beta-Sitosterol | 60% to 100% | Sterols, Oxygenated Terpenes and other Isoprenoids |
| 57-88-5 | Cholesterol | 60% to 90% | Sterols, Oxygenated Terpenes and other Isoprenoids |
| 59-02-9 | alpha-Tocopherol | 450% to 540% | Sterols, Oxygenated Terpenes and other Isoprenoids |
| 83-46-5 | beta-Sitosterol | 60% to 90% | Sterols, Oxygenated Terpenes and other Isoprenoids |
| 13190-97-1 | Solanesol | NEW | Sterols, Oxygenated Terpenes and other Isoprenoids |
| 14745-36-9 | alpha-Tocopherol hydroquinone | NEW | Sterols, Oxygenated Terpenes and other Isoprenoids |
| 148-03-8 | beta-Tocopherol | 60% to 80% | Sterols, Oxygenated Terpenes and other Isoprenoids |
| 17605-67-3 | Fucosterol | 60% to 120% | Sterols, Oxygenated Terpenes and other Isoprenoids |
| 474-62-4 | Campesterol | 140% to 180% | Sterols, Oxygenated Terpenes and other Isoprenoids |
| 83-46-5 | beta-Sitosterol | 80% to 130% | Sterols, Oxygenated Terpenes and other Isoprenoids |
| 83-48-7 | Stigmasterol | NEW | Sterols, Oxygenated Terpenes and other Isoprenoids |
| 999999-99-9 | F1-U1.165 | NEW | NA |

FIGURE 10-FFFF

A list of metabolite compounds present in altered levels relative to reference samples as chararacterized by liquid chromatography. This list corresponds to samples transfected with nucleic acid sequence, Seq 25080, SEQ ID NO:337

| Compound CAS# | Compound Name | Modification | Compound Class |
|---|---|---|---|
| 56-41-7 (RT) | Alanine | 30% to 160% | Amino Acids and related Compounds |
| 56-89-3 (RT) | Cysteine | 315% to 640% | Amino Acids and related Compounds |
| 56-40-6 (RT) | Glycine | 300% to 2475% | Amino Acids and related Compounds |
| 72-19-5 (RT) | Threonine | 35% to 200% | Amino Acids and related Compounds |

NUCLEIC ACIDS COMPOSITIONS CONFERRING DWARFING PHENOTYPE

This application is the National Stage of International Application No. PCT/US01/23120, filed Jul. 20, 2001, which claims the benefit under 35 U.S.C. 119(e) of U.S. Provisional Applications 60/219,809 filed Jul. 20, 2000 and 60/219,810 filed Jul. 20, 2000.

FIELD OF THE INVENTION

This invention relates to putative known and unknown deoxyribonucleic acid (DNA) and amino acid sequences identified in one or more metabolic pathways that lead to dwarfism and stunting in plants and the use of these sequences in agriculture to create dwarf varieties of any plant species. This invention also relates to nucleic acid sequences and polypeptides that alter metabolism in plants.

BACKGROUND OF THE INVENTION

The Green Revolution crops, introduced in the late 1960s and early 1970s, produce several times as much grain as the traditional varieties they replaced, and they spread rapidly. They enabled India to double its wheat crop in seven years, dramatically increasing food supplies and averting widely predicted famine. The Green Revolution's leading research achievement was to hasten the perfection of dwarf spring wheat. Though it is conventionally assumed that farmers want a tall, impressive-looking harvest, in fact shrinking wheat and other crops has often proved beneficial. Bred for short stalks, plants expend less energy on growing inedible column sections and more on growing valuable grain. Stout, short-stalked wheat also neatly supports its kernels, whereas tall-stalked wheat may bend over at maturity, complicating reaping. Nature has favored genes for tall stalks, because in nature plants must compete for access to sunlight. In high-yield agriculture equally short-stalked plants will receive equal sunlight. Researchers are seeking dwarf strains of rice and other crops in order to increase agronomic yields. Identification of genes and metabolic pathway modifications that can be used for creation of rapidly growing dwarf strains would be especially useful for grain and cereal crops and also for other agronomically important crops such as forest trees, ornamental species such as turfgrass, and plants such as *Nicotiana* sp. grown as hosts for biopharmaceutical manufacturing.

The discovery of putative known and unknown DNA and amino acid sequences identified in one or more metabolic pathways leading to dwarfism and stunting in plants satisfies a need in the art by providing new compositions which are useful in agriculture to create dwarf varieties of any plant species.

SUMMARY OF THE INVENTION

This invention relates to putative known and unknown deoxyribonucleic acid (DNA) and amino acid sequences identified in one or more metabolic pathways that lead to dwarfism and stunting in plants and the use of these sequences in agriculture to create dwarf varieties of any plant species. This invention also relates to nucleic acids sequences and polypeptides, the expression of which cause altered metabolism and fatty acid production in plants.

In some embodiments, the present invention provides a composition comprising a nucleic acid selected from the group consisting of SEQ ID NOs:1-571. The present invention is not limited to the particular nucleic acid encoded by these sequences. Indeed, it is contemplated that the present invention contemplates variants, homologs, and portions or fragments of these sequences. Therefore, in some embodiments, the present invention provides a composition comprising a nucleic acid sequence that hybridizes to a sequence selected from the group consisting of SEQ ID NOs:1-571 under conditions ranging from low to high stringency. In still further embodiments, the present invention provides a composition comprising a nucleic acid that inhibits or competes with the binding a nucleic acid selected from the group consisting of SEQ ID NOs:1-571 to their complements. In other embodiments, the present invention provides a composition comprising a nucleic acid that hybridizes to a sequence selected from the group of SEQ ID NOs:1-571 and which confers a dwarfing phenotype or altered metabolism phenotype when expressed in a plant.

In still further preferred embodiments, the present invention provides a vector comprising a nucleic acid selected from the group consisting of SEQ ID NOs:1-571. The present invention is not limited to the particular nucleic acid encoded by these sequences. Indeed, it is contemplated that the present invention contemplates variants, homologs, and portions or fragments of these sequences. Therefore, in some embodiments, the present invention provides a vector comprising a nucleic acid sequence that hybridizes to a sequence selected from the group consisting of SEQ ID NOs:1-571 under conditions ranging from low to high stringency. In still further embodiments, the present invention provides a vector comprising a nucleic acid that inhibits or competes with the binding a nucleic acid selected from the group consisting of SEQ ID NOs:1-571 to their complements. In other embodiments, the present invention provides a vector comprising a nucleic acid that hybridizes to a sequence selected from the group of SEQ ID NOs:1-571 and which confers a dwarfing or altered metabolism phenotype when expressed in a plant.

In some embodiments, the present invention comprises a plant transfected with the nucleic acids or vectors described above. In still further embodiments, the present invention comprises the seeds, leaves, or oil produced by the transfected plants.

In some preferred embodiments, the present invention provides a composition comprising a nucleic acid selected from the group consisting of SEQ ID NOs:43, 49, 52, 79, 94, and 151. The present invention is not limited to the particular nucleic acid encoded by these sequences. Indeed, it is contemplated that the present invention contemplates variants, homologs, and portions or fragments of these sequences. Therefore, in some embodiments, the present invention provides a composition comprising a nucleic acid sequence that hybridizes to a sequence selected from the group consisting of SEQ ID NOs:43, 49, 52, 79, 94, and 151 under conditions ranging from low to high stringency. In still further embodiments, the present invention provides a composition comprising a nucleic acid that inhibits or competes with the binding a nucleic acid selected from the group consisting of SEQ ID NOs:43, 49, 52, 79, 94, and 151 to their complements. In other embodiments, the present invention provides a composition comprising a nucleic acid that hybridizes to a sequence selected from the group of SEQ ID NOs:43, 49, 52, 79, 94, and 151 and which confers a phenotype when expressed in a plant, the phenotype selected from the group consisting of dwarfing, alteration of fatty acid synthesis, and alteration of metabolism.

In still further preferred embodiments, the present invention provides a vector comprising a nucleic acid selected from the group consisting of SEQ ID NOs:43, 49, 52, 79, 94, and 151. The present invention is not limited to the particular nucleic acid encoded by these sequences. Indeed, it is contemplated that the present invention contemplates variants, homologs, and portions or fragments of these sequences. Therefore, in some embodiments, the present invention provides a vector comprising a nucleic acid sequence that hybridizes to a sequence selected from the group consisting of SEQ ID NOs:43, 49, 52, 79, 94, and 151 under conditions ranging from low to high stringency. In still further embodiments, the present invention provides a vector comprising a nucleic acid that inhibits or competes with the binding a nucleic acid selected from the group consisting of SEQ ID NOs:43, 49, 52, 79, 94, and 151 to their complements. In other embodiments, the present invention provides a vector comprising a nucleic acid that hybridizes to a sequence selected from the group of SEQ ID NOs:43, 49, 52, 79, 94, and 151 and which confers a phenotype when expressed in a plant, the phenotype selected from the group consisting of dwarfing, alteration of fatty acid synthesis, and alteration of metabolism.

In some embodiments, the present invention comprises a plant transfected with the nucleic acids or vectors described above. In still further embodiments, the present invention comprises the seeds or oil produced by the transfected plants.

In some embodiments, the present invention provides methods comprising providing i) a vector comprising a nucleic acid sequence selected from the group consisting of SEQ ID NOs:43, 49, 52, 79, 94, and 151; ii) a host cell; and transfecting the host cell with the vector under conditions such that fatty acid synthesis by the host cell is altered. In some preferred embodiments, the host cells are part of a plant.

In other embodiments, the present invention provides methods comprising providing i) a vector comprising a nucleic acid sequence selected from the group consisting nucleic acid sequences that hybridize to a sequence selected from the group consisting of SEQ ID NOs:43, 49, 52, 79, 94, and 151 under conditions of high stringency; ii) a host cell; and transfecting the host cell with the vector under conditions such that fatty acid synthesis by the host cell is altered. In some preferred embodiments, the host cells are part of a plant.

In some embodiments, the present invention provides methods comprising providing i) a vector comprising a nucleic acid sequence selected from the group consisting of SEQ ID NOs:43, 49, 52, 79, 94, and 151; ii) a host cell; and transfecting the host cell with the vector under conditions such that the metabolism the host cell is altered. In some preferred embodiments, the host cells are part of a plant.

In other embodiments, the present invention provides methods comprising providing i) a vector comprising a nucleic acid sequence selected from the group consisting of nucleic acid sequences that hybridize to a sequence selected from the group consisting of SEQ ID NOs:43, 49, 52, 79, 94, and 151 under conditions of high stringency; ii) a host cell; and transfecting the host cell with the vector under conditions such that the metabolism the host cell is altered. In some preferred embodiments, the host cells are part of a plant.

In further embodiments, the present invention provides methods for producing dwarf industrial crops. It is contemplated that these dwarf industrial crops will have increased yields as compared non-dwarf industrial crops. Therefore, in some embodiments, the present invention provides methods comprising providing i) a nucleic acid selected from the group consisting of SEQ ID NOs:1-154 and ii) a plant or plant tissue; and transfecting the plant or plant tissue with the nucleic acid such that it is expressed in at least a portion of the plant tissue or plant. The present invention is not limited to the particular sequences encoded by SEQ ID NOs: 1-154. Indeed, a variety of nucleic acid sequences are contemplated. In particular, the present invention encompasses nucleic acid sequences that bind to SEQ ID NOs: 1-154 under conditions of low to high stringency. In other embodiments, the present invention encompasses the use of nucleic acids that inhibit or compete with the binding nucleic acids encoded by SEQ ID NOs: 1-154 and their complements. In some embodiments, the nucleic acid is contained within a vector. In other embodiments, the nucleic acid is operably linked to a constitutive or tissue specific promoter. When a tissue specific promoter is utilized, it is contemplated that the dwarfing effect will be confined substantially to the tissue where the nucleic acid is expressed. The present invention is not limited to any particular tissue specific promoter. Indeed, a variety of tissue specific promoters are contemplated, including, but not limited to, leaf, seed, stem, and root specific promoters. In other embodiments, the expression of the nucleic acid is increased as compared to wild-type plants. In still other embodiments, the nucleic acid is expressed under conditions that a dwarf phenotype is observed. The present invention is not limited to any particular industrial crop. Indeed, a variety of industrial crops are contemplated. In preferred embodiments, the industrial crop is selected from corn, soybean, rice, wheat, oilseed rape, cotton, oats, barley, and potato.

In still further preferred embodiments, the present invention provides the plants produced from the above method. In some embodiments, the invention provides a plant comprising a nucleic acid corresponding to at least one of SEQ ID NOs. 1-154. The present invention is not limited to the particular sequences encoded by SEQ ID NOs: 1-154. Indeed, a variety of nucleic acid sequences are contemplated. In particular, the present invention encompasses nucleic acid sequences that bind to SEQ ID NOs: 1-154 under conditions of low to high stringency. In other embodiments, the present invention encompasses the use of nucleic acids that inhibit or compete with the binding nucleic acids encoded by SEQ ID NOs: 1-154 and their complements. In some embodiments, the nucleic acid is contained within a vector. In further embodiments, the nucleic acid is operably linked to a constitutive or tissue specific promoter. When a tissue specific promoter is utilized, it is contemplated that the dwarfing effect will be confined substantially to the tissue where the nucleic acid is expressed. The present invention is not limited to any particular tissue specific promoter. Indeed, a variety of tissue specific promoters are contemplated, including, but not limited to, leaf, seed, stem, and root specific promoters. In other embodiments, the expression of the nucleic acid is increased as compared to wild-type plants. In still other embodiments, the nucleic acid is expressed under conditions so that a dwarf phenotype is observed. The present invention is not limited to any particular industrial crop. Indeed, a variety of industrial crops are contemplated. In preferred embodiments, the industrial crop is selected from corn, soybean, rice, wheat, oilseed rape, cotton, oats, barley, and potato.

In some embodiments, the present invention comprises a plant transfected with the nucleic acids or vectors described above. In still further embodiments, the present invention comprises the seeds or oil produced by the transfected plants.

In still further embodiments, the present invention provides nucleic acids corresponding to contigs and orthologs or homologs predicted from the sequences that cause a stunting or dwarfing phenotype. Accordingly, in some embodiments, the present invention provides a composition comprising a nucleic acid selected from the group consisting of SEQ ID NOs: 155-279 and 344-571. In still further embodiments, the present invention provides a vector comprising a nucleic acid selected from the group consisting of SEQ ID NOs: 155-279 and 344-571. The present invention is not limited to the contig sequences disclosed herein. The present invention also encompasses orthologs and homologs of the contig sequences. Therefore, the present invention provides compositions comprising a nucleic acid sequence that hybridizes to a sequence selected from the group consisting of SEQ ID NOs: 155-279 and 344-571 under conditions of low to high stringency. In other embodiments, the present invention provides a composition comprising a nucleic acid that inhibits the binding of a nucleic acid selected from the group consisting of SEQ ID NOs: 155-279 and 344-571 to their complementary sequences.

In other embodiments, the present invention provides plants transformed with the contig sequences or vectors comprising the contig sequences. The present invention is not limited to any particular plant. Indeed, a variety of plants are contemplated, including, but not limited to, corn, soybean, rice, wheat, oilseed rape, cotton, oats, barley, and potato plants.

In still other embodiments, the present invention provides methods comprising providing i) a vector comprising a nucleic acid sequence selected from the group consisting of SEQ ID NOs: 155-279 and 344-571; ii) a host cell; and transfecting the host cell with the vector under conditions such that fatty acid synthesis by the host cell is altered. In some preferred embodiments, the host cells are part of a plant.

In still further embodiments, the present invention provides methods comprising providing i) a vector comprising a nucleic acid sequence selected from the group consisting of nucleic acid sequences that hybridize to a sequence selected from the group consisting of SEQ ID NOs: 155-279 and 344-571 under conditions of low to high stringency; and a host cell; and transfecting the host cell with the vector under conditions such that fatty acid synthesis by the host cell is altered. In some embodiments, the present invention provides a composition comprising a nucleic acid that inhibits the binding of a nucleic acid selected from the group consisting of SEQ ID NOs: 155-279 and 344-571 to their complementary sequences.

The present invention also provides methods for decreasing the susceptibility of plants to insects and pests and increasing the resistance and tolerance of plants to insects and pests. It is contemplated that expression of the nucleic acids in plants can lead to insect tolerance or resistance by a variety of methods. In some instances, expression of the nucleic acid sequence results in the production of a polypeptide that is directly toxic to an insect. In other instances, resistance or tolerance is conferred through a secondary effect of expression of the nucleic acid (for example, expression results in the production of metabolic compounds, such as sterols, that are toxic to an insect).

In some embodiments, the present invention provides methods comprising providing i) a nucleic acid selected from the group consisting of SEQ ID NOs: 3, 150, 151, 26, 31, 36, 58, 78, 94, 106, 107, 110, 112, 113, 114, 117, 123; and ii) a plant having susceptibility to insects; and transfecting the plant with the nucleic acid sequence under conditions such that the susceptibility is reduced.

In other embodiments, the present invention provides methods comprising providing i) a nucleic acid that hybridizes to a sequence selected from the group consisting of SEQ ID NOs: 3, 150, 151, 26, 31, 36, 58, 78, 94, 106, 107, 110, 112, 113, 114, 117, 123 under conditions of low to high stringency; and ii) a plant having susceptibility to insects; and transfecting the plant with the nucleic acid sequence under conditions such that the susceptibility is reduced.

In further embodiments, the present invention provides methods comprising providing i) a vector comprising a nucleic acid sequence selected from the group consisting of SEQ ID NOs: 3, 150, 151, 26, 31, 36, 58, 78, 94, 106, 107, 110, 112, 113, 114, 117, 123; and ii) a plant having susceptibility to insects; and transfecting the plant with the nucleic acid sequence under conditions such that the susceptibility is reduced.

In still further embodiments, the present invention provides methods comprising providing i) a vector comprising a nucleic acid sequence that hybridizes to a sequence selected from the group consisting of SEQ ID NOs: 3, 150, 151, 26, 31, 36, 58, 78, 94, 106, 107, 110, 112, 113, 114, 117, 123 under conditions of low to high stringency; and ii) a plant having susceptibility to insects; and transfecting the plant with the nucleic acid sequence under conditions such that the susceptibility is reduced.

In some embodiments, the present intention provides methods providing i) a composition comprising a nucleic acid that hybridizes to a sequence selected from the group consisting of SEQ ID NOs: 3, 150, 151, 26, 31, 36, 58, 78, 94, 106, 107, 110, 112, 113, 114, 117, 123 under conditions of low to high stringency; and ii) a plant; and transfecting the plant with the composition under conditions such the resistance of the plant to insects is increased.

In still other embodiments, the present invention provides methods comprising providing i) a composition comprising a nucleic acid that hybridizes to a sequence selected from the group consisting of SEQ ID NOs: 3, 150, 151, 26, 31, 36, 58, 78, 94, 106, 107, 110, 112, 113, 114, 117, 123 under conditions of low to high stringency; and ii) a plant; and transfecting the plant with the composition under conditions such that the tolerance of the plants to insects is increased.

In some embodiments, the nucleic acid sequences are operably linked to a promoter (for example, a constitutive or tissue specific promoter). The present invention is not limited to any particular tissue specific promoter. Indeed, a variety of tissue specific promoters are contemplated, including, but not limited to, leaf, seed, stem, and root specific promoters.

In some embodiments, the present invention provides a composition comprising a polypeptide encoded by nucleic acids selected from the group consisting of SEQ ID NOs: SEQ ID NOs: 3, 150, 151, 26, 31, 36, 58, 78, 94, 106, 107, 110, 112, 113, 114, 117, 123 and portions thereof. In still further embodiments, the present invention provides methods for controlling an insect comprising providing a composition comprising a polypeptide encoded by a nucleic acid selected from the group consisting of SEQ ID NOs: 3, 150, 151, 26, 31, 36, 58, 78, 94, 106, 107, 110, 112, 113, 114, 117, 123 and portions thereof; and orally introducing to an insect an insecticidally effective amount of the polypeptide.

In still further preferred embodiments, the present invention provides an isolated nucleic acid comprising one of SEQ ID NOs: 334, 280, 335, 336, 281, 282, 283, 284, 285, 286, 287, 288, 289, 338, 290, 291, 292, 293, 294, 295, 296, 297, 298, 299, 339, 300, 301, 302, 303, 304, 306,307,308, 309, 310, 311, 312, 314, 315, 316, 317, 318, 319, 320, 321, 322, 323, 324, 326, 327, 328, 329, 330, 333, or 337 or sequences that hybridize to the foregoing sequences under conditions of low stringency, wherein expression of the nucleic acid in a plant results in an altered metabolism phenotype. In some preferred embodiments, the present invention provides a vector comprising one the foregoing sequences. In particularly preferred embodiments, the nucleic acid is operably linked to an exogenous promoter, preferably a plant promoter. In some embodiments, the nucleic acid is in sense orientation while in other embodiments, the nucleic acid is in antisense orientation.

In still further embodiments, the present invention provides a plant transfected with a nucleic acid, composition, or vector comprising one of SEQ ID NOs: 334, 280, 335, 336, 281, 282, 283, 284, 285, 286, 287, 288, 289, 338, 290, 291, 292, 293, 294, 295, 296, 297, 298, 299, 339, 300, 301, 302, 303, 304, 306, 307, 308, 309, 310, 311, 312, 314, 315, 316, 317, 318, 319, 320, 321, 322, 323, 324, 326, 327, 328, 329, 330, 333, or 337 or sequences that hybridize to the foregoing sequences under conditions of low stringency. In some embodiments, the present invention provides a seed from such a plant. In other embodiments, the present invention provides a leaf from such a plant.

In still further embodiments, the present invention provides and nucleic acid, composition, or vector comprising one of SEQ ID NOs: 334, 280, 335, 336, 281, 282, 283, 284, 285, 286, 287, 288, 289, 338, 290, 291, 292, 293, 294, 295, 296, 297, 298, 299, 339, 300, 301, 302, 303, 304, 306, 307, 308, 309, 310, 311, 312, 314, 315, 316, 317, 318, 319, 320, 321, 322, 323, 324, 326, 327, 328, 329, 330, 333, or 337 or sequences that hybridize to the foregoing sequences under conditions of low stringency for use in altering the metabolism of a plant.

In some embodiments, the present invention provides methods and/or processes for making a transgenic plant comprising providing a vector comprising one of SEQ ID NOs: 334, 280, 335, 336, 281, 282, 283, 284, 285, 286, 287, 288, 289, 338, 290, 291, 292, 293, 294, 295, 296, 297, 298, 299, 339, 300, 301, 302, 303, 304, 306, 307, 308, 309, 310, 311, 312, 314, 315, 316, 317, 318, 319, 320, 321, 322, 323, 324, 326, 327, 328, 329, 330, 333, or 337 or sequences that hybridize to the foregoing sequences under conditions of low stringency and a plant; and transfecting the plant with the vector. In other embodiments, the present invention provides methods and/or processes for altering the metabolism of a plant comprising providing a vector comprising one of SEQ ID NOs: 334, 280, 335, 336, 281, 282, 283, 284, 285, 286, 287, 288, 289, 338, 290, 291, 292, 293, 294, 295, 296, 297, 298, 299, 339, 300, 301, 302, 303, 304, 306, 307, 308, 309, 310, 311, 312, 314, 315, 316, 317, 318, 319, 320, 321, 322, 323, 324, 326, 327, 328, 329, 330, 333, or 337 or sequences that hybridize to the foregoing sequences under conditions of low stringency and a plant; and transfecting the plant with the vector under conditions such that the metabolism of the plant is altered.

In still further preferred embodiments, the present invention provides an isolated nucleic acid selected from the group consisting of SEQ ID NOs: 334, 280, 335, 336, 281, 282, 283, 284, 285, 286, 287, 288, 289, 338, 290, 291, 292, 293, 294, 295, 296, 297, 298, 299, 339, 300, 301, 302, 303, 304, 306, 307, 308, 309, 310, 311, 312, 314, 315, 316, 317, 318, 319, 320, 321, 322, 323, 324, 326, 327, 328, 329, 330, 333, 337 and nucleic acid sequences that hybridize to any thereof under conditions of low stringency for use in altering the metabolism of a plant.

In still other embodiments, the present invention provides an isolated nucleic acid comprising one of SEQ ID NOs: 47, 58, 336, 288, 291, 297, 302, 304, 313, 321, 322, 323, 324, 325, 326, 327, 328, 329, 330, 331, or 332 or sequences that hybridize to the foregoing sequences under conditions of low stringency, wherein expression of the sequences in a plant results in a stunting phenotype. In some preferred embodiments, the present invention provides a vector comprising one the foregoing sequences. In particularly preferred embodiments, the nucleic acid is operably linked to an exogenous promoter, preferably a plant promoter.

In some embodiments, the nucleic acid is in sense orientation while in other embodiments, the nucleic acid is in antisense orientation. In still further embodiments, the present invention provides a plant transfected with a nucleic acid, composition, or vector comprising one of SEQ ID NOs: 47, 58, 336, 288, 291, 297, 302, 304, 313, 321, 322, 323, 324, 325, 326, 327, 328, 329, 330, 331, or 332 or sequences that hybridize to the foregoing sequences under conditions of low stringency. In some embodiments, the present invention provides a seed from such a plant. In other embodiments, the present invention provides a leaf from such a plant.

In still further embodiments, the present invention provides and nucleic acid, composition, or vector comprising one of SEQ ID NOs: 47, 58, 336, 288, 291, 297, 302, 304, 313, 321, 322, 323, 324, 325, 326, 327, 328, 329, 330, 331, or 332 or sequences that hybridize to the foregoing sequences under conditions of low stringency for use in stunting the growth of a plant or particular tissue of a plant.

In some embodiments, the present invention provides methods and/or processes for making a transgenic plant comprising providing a vector comprising one of SEQ ID NOs: 47, 58, 336, 288, 291, 297, 302, 304, 313, 321, 322, 323, 324, 325, 326, 327, 328, 329, 330, 331, or 332 or sequences that hybridize to the foregoing sequences under conditions of low stringency and a plant; and transfecting the plant with the vector. In other embodiments, the present invention provides methods and/or processes for altering the metabolism of a plant comprising providing a vector comprising one of SEQ ID NOs: 47, 58, 336, 288, 291, 297, 302, 304, 313, 321, 322, 323, 324, 325, 326, 327, 328, 329, 330, 331, or 332 or sequences that hybridize to the foregoing sequences under conditions of low stringency and a plant; and transfecting the plant with the vector under conditions such that the growth of the plant or a particular tissue of the plant is stunted.

In still other embodiments, the present invention provides an isolated nucleic acid selected from the group consisting of SEQ ID NOs: 47, 58, 336, 288, 291, 297, 302, 304, 313, 321, 322, 323, 324, 325, 326, 327, 328, 329, 330, 331, 332, and nucleic acid sequences that hybridize to any thereof under conditions of low stringency for use in producing a stunting phenotype in a plant.

In further embodiments, the nucleic acid is operably linked to a constitutive or tissue specific promoter. When a tissue specific promoter is utilized, it is contemplated that the dwarfing effect will be confined substantially to the tissue where the nucleic acid is expressed. The present invention is not limited to any particular tissue specific promoter. Indeed, a variety of tissue specific promoters are contemplated, including, but not limited to, leaf, seed, stem, and root specific promoters. In other embodiments, the expression of the nucleic acid is increased as compared to wild-type plants. In still other embodiments, the nucleic acid is expressed under conditions that a dwarf phenotype is observed. The present invention is not limited to any particular industrial crop. Indeed, a variety of industrial crops are contemplated. In preferred embodiments, the industrial crop is selected from corn, soybean, rice, wheat, oilseed rape, cotton, oats, barley, and potato.

In still other embodiments, the present invention provides a nucleic acid, composition, vector, or plant substantially as described herein in any of the examples.

In still other embodiments, the present invention provides methods and/or processes for the characterization of fractionated biological samples, comprising providing i) one or more fractionated biological samples; ii) a plurality of references samples; iii) a gas chromatography apparatus; iv) a mass spectroscopy apparatus; and v) data analysis software; and treating the fractionated biological samples and the reference samples with the gas chromatography apparatus to generate chromatographic data corresponding to the fractionated biological samples and the reference samples; treating the fractionated biological samples and the reference samples with the mass spectroscopy apparatus to generate spectroscopic data corresponding to the fractionated biological samples and the reference samples; and processing the chromatographic and the spectroscopic data with the data analysis software, wherein the processing comprises the steps of data reduction, two-dimensional peak matching, quantitative peak differentiation, peak identification, data sorting, and customized reporting.

In some particularly preferred embodiments, data reduction comprises the generation of peak tables corresponding to the chromatographic data. In further embodiments, the peak tables comprise retention time, retention index, raw peak areas, and normalized peak areas data corresponding to the chromatographic data. In still further embodiments, the two-dimensional peak matching comprises the steps of a) matching peaks from the chromatographic data corresponding to the reference sample and the spectral data corresponding to the biological samples to generated paired peaks, wherein the paired peaks have the same retention index; and b) matching the paired peaks based on the spectroscopic data to generate matched peaks and unmatched peaks. In still further embodiments, quantitative peak differentiation comprises further processing the matched peaks to determine a threshold of change for each of the matched peaks.

In still further embodiments, matched peaks not meeting a minimum threshold for change are discarded. In still further embodiments, peak identification comprises searching mass spectral libraries with the spectroscopic data. In still further embodiments, a searching step generates chemical abstract services numbers corresponding to the peaks. In other embodiments, peak identification further comprises searching biotechnology databases, wherein the biotechnology databases comprises chemical structures. In some embodiments, data sorting comprises generating an preliminary analyst report corresponding to the biological samples. In further embodiments, custom reporting comprises modifying the preliminary analyst report to generate a final report.

DESCRIPTION OF THE DRAWINGS

FIGS. 1*a-pp* provide sequences for SEQ ID NOs: 1-154 and 279.

FIGS. 2*a-f* provide sequences for SEQ ID NOs: 155-171.
FIGS. 3*a-c* provide sequences for SEQ ID NOs: 172-179.
FIGS. 4*a-n* provide sequences for SEQ ID NOs: 180-216.
FIGS. 5*a-l* provide sequences for SEQ ID NOs: 217-279.
FIGS. 6*a-d* provide a Table presenting the orientation of 152 of the sequences.

FIGS. 7*a-7q* provide sequences for SEQ ID NOs: 280-343.

FIGS. 8*a-d* summarize the GC/FID parameters used to analyze metabolite samples.

FIGS. 9*a-9ppp* provide sequences for SEQ ID NOs:344-571.

FIGS. 10*a-10ffff* provide tables summarizing the metabolic changes produced by expression of the indicated sequences in plants.

DEFINITIONS

Before the present proteins, nucleotide sequences, and methods are described, it should be noted that this invention is not limited to the particular methodology, protocols, cell lines, vectors, and reagents described herein as these may vary. It should also be understood that the terminology used herein is for the purpose of describing particular aspects of the invention, and is not intended to limit its scope, which will be limited only by the appended claims.

It must be noted that as used herein and in the appended claims, the singular forms "a", "an", and "the" include plural reference unless the context clearly dictates otherwise. Thus, for example, reference to "a host cell" includes a plurality of such host cells, reference to the "antibody" is a reference to one or more antibodies and equivalents thereof known to those skilled in the art, and so forth.

Unless defined otherwise, all technical and scientific terms used herein have the same meanings as commonly understood by one of ordinary skill in the art to which this invention belongs. Although any methods and materials similar or equivalent to those described herein can be used in the practice or testing of the present invention, the preferred methods, devices, and materials are now described. All publications mentioned herein are incorporated herein by reference for the purpose of describing and disclosing the cell lines, vectors, and methodologies which are reported in the publications which might be used in connection with the invention. Nothing herein is to be construed as an admission that the invention is not entitled to antedate such disclosure by virtue of prior invention.

"Acylate", as used herein, refers to the introduction of an acyl group into a molecule, (for example, acylation).

"Adjacent", as used herein, refers to a position in a nucleotide sequence immediately 5' or 3' to a defined sequence.

"Agonist", as used herein, refers to a molecule which, when bound to a polypeptide (for example, a polypeptide encoded by a nucleic acid of the present invention), increases the biological or immunological activity of the polypeptide. Agonists may include proteins, nucleic acids, carbohydrates, or any other molecules which bind to the protein.

"Alterations" in a polynucleotide (for example, a polypeptide encoded by a nucleic acid of the present invention), as used herein, comprise any deletions, insertions, and point mutations in the polynucleotide sequence. Included within this definition are alterations to the genomic DNA sequence which encodes the polypeptide.

"Amino acid sequence", as used herein, refers to an oligopeptide, peptide, polypeptide, or protein sequence, and fragments or portions thereof, and to naturally occurring or synthetic molecules. "Amino acid sequence" and like terms, such as "polypeptide" or "protein" as recited herein are not meant to limit the amino acid sequence to the complete, native amino acid sequence associated with the recited protein molecule.

"Amplification", as used herein, refers to the production of additional copies of a nucleic acid sequence and is generally carried out using polymerase chain reaction (PCR) technologies well known in the art (Dieffenbach, C. W. and G. S. Dveksler (1995) PCR Primer, a Laboratory Manual, Cold Spring Harbor Press, Plainview, N.Y.).

"Antibody" refers to intact molecules as well as fragments thereof which are capable of specific binding to a epitopic determinant. Antibodies that bind a polypeptide (for example, a polypeptide encoded by a nucleic acid of the present invention) can be prepared using intact polypeptides or fragments as the immunizing antigen. These antigens may be conjugated to a carrier protein, if desired.

"Antigenic determinant", "determinant group", or "epitope of an antigenic macromolecule", as used herein, refer to any region of the macromolecule with the ability or potential to elicit, and combine with, specific antibody. Determinants exposed on the surface of the macromolecule are likely to be immunodominant, that is, more immunogenic than other (immunorecessive) determinants which are less exposed, while some (for example, those within the molecule) are non-immunogenic (immunosilent). As used herein, "antigenic determinant" refers to that portion of a molecule that makes contact with a particular antibody (for example, an epitope). When a protein or fragment of a protein is used to immunize a host animal, numerous regions of the protein may induce the production of antibodies which bind specifically to a given region or three-dimensional structure on the protein; these regions or structures are referred to as antigenic determinants. An antigenic determinant may compete with the intact antigen (the immunogen used to elicit the immune response) for binding to an antibody.

The term "antisense", as used herein, refers to a deoxyribonucleotide sequence whose sequence of deoxyribonucleotide residues is in reverse 5' to 3' orientation in relation to the sequence of deoxyribonucleotide residues in a sense strand of a DNA duplex. A "sense strand" of a DNA duplex refers to a strand in a DNA duplex which is transcribed by a cell in its natural state into a "sense mRNA." Thus an "antisense" sequence is a sequence having the same sequence as the non-coding strand in a DNA duplex. The term "antisense RNA" refers to a RNA transcript that is complementary to all or part of a target primary transcript or mRNA and that blocks the expression of a target gene by interfering with the processing, transport and/or translation of its primary transcript or mRNA. The complementarity of an antisense RNA may be with any part of the specific gene transcript, for example, at the 5' non-coding sequence, 3' non-coding sequence, introns, or the coding sequence. In addition, as used herein, antisense RNA may contain regions of ribozyme sequences that increase the efficacy of antisense RNA to block gene expression. "Ribozyme" refers to a catalytic RNA and includes sequence-specific endoribonucleases. "Antisense inhibition" refers to the production of antisense RNA transcripts capable of preventing the expression of the target protein.

"Anti-sense inhibition", as used herein, refers to a type of gene regulation based on cytoplasmic, nuclear, or organelle inhibition of gene expression due to the presence in a cell of an RNA molecule complementary to at least a portion of the mRNA being translated. It is specifically contemplated that DNA molecules may be from either an RNA virus or mRNA from the host cell genome or from a DNA virus.

"Antagonist" or "inhibitor", as used herein, refer to a molecule which, when bound to a polypeptide (for example, a polypeptide encoded by a nucleic acid of the present invention), decreases the biological or immunological activity of the polypeptide. Antagonists and inhibitors may include proteins, nucleic acids, carbohydrates, or any other molecules that bind to the polypeptide.

"Biologically active", as used herein, refers to a molecule having the structural, regulatory, or biochemical functions of a naturally occurring molecule.

"Cell culture", as used herein, refers to a proliferating mass of cells that may be in either an undifferentiated or differentiated state.

"Chimeric plasmid", as used herein, refers to any recombinant plasmid formed (by cloning techniques) from nucleic acids derived from organisms which do not normally exchange genetic information (for example, *Escherichia coli* and *Saccharomyces cerevisiae*).

"Chimeric sequence" or "chimeric gene", as used herein, refer to a nucleotide sequence derived from at least two heterologous parts. The sequence may comprise DNA or RNA.

As used herein, the term "chromatographic data" refers to total ion chromatograms corresponding to individual biological or reference samples. Data such as retention time, retention index, peak areas, and peak areas normalized to internal standards can be extracted from total ion chromatograms to generate "peak tables."

"Coding sequence", as used herein, refers to a deoxyribonucleotide sequence which, when transcribed and translated, results in the formation of a cellular polypeptide or a ribonucleotide sequence which, when translated, results in the formation of a cellular polypeptide.

"Compatible", as used herein, refers to the capability of operating with other components of a system. A vector or plant viral nucleic acid which is compatible with a host is one which is capable of replicating in that host. A coat protein which is compatible with a viral nucleotide sequence is one capable of encapsidating that viral sequence.

"Coding region", as used herein, refers to that portion of a gene which codes for a protein. The term "non-coding region" refers to that portion of a gene that is not a coding region.

"Complementary" or "complementarity", as used herein, refer to the Watson-Crick base-pairing of two nucleic acid sequences. For example, for the sequence 5'-AGT-3' binds to the complementary sequence 3'-TCA-5'. Complementarity between two nucleic acid sequences may be "partial", in which only some of the bases bind to their complement, or it may be complete as when every base in the sequence binds to it's complementary base. The degree of complementarity between nucleic acid strands has significant effects on the efficiency and strength of hybridization between nucleic acid strands.

As used herein, the term "contig" refers to a nucleic acid sequence that is derived from the contiguous assembly of two or more nucleic acid sequences.

"Correlates with expression of a polynucleotide", as used herein, indicates that the detection of the presence of ribonucleic acid that is similar to a nucleic acid (for example, SEQ ID NOs:1-571) and is indicative of the presence of mRNA encoding a polypeptide (for example, a polypeptide encoded by a nucleic acid of the present invention) in a sample and thereby correlates with expression of the transcript from the polynucleotide encoding the protein.

As used herein, the term "customized reporting" refers to the modification of a preliminary analyst report to generate a modified analyst report. In some embodiments, modifications include, but are not limited to, substitution of underivatized compound names for derivatized compound names and generation of a hit score.

As used herein, the term "data analysis software" refers to software configured for the analysis of spectroscopic and chromatographic data corresponding to fractioned biological and reference samples. Data analysis software is configured to perform data reduction, two dimensional peak matching, quantitative peak differentiation, peak identification, and customized reporting functions.

As used herein, the term "data reduction" refers to the process of organizing, compiling, and normalizing data (for example, chromatographic data and spectroscopic data). In some embodiments, data reduction includes the normalization of raw chromatogram peak areas and the generation of peak tables. In some embodiments, data reduction also includes the process of filtering peaks based on their normalized area. This step removes peaks that are considered to be background.

As used herein, the term "data sorting" refers to the generation of a preliminary analyst report. In some embodiment, the preliminary analyst report includes equivalence value, retention time, retention index, normalized peak are, peak identification status, compound name, CAS number, mass spectral library, ID number, MS-XCR value, relative % change, notes, and other information about the fractionated biological sample.

"Deletion", as used herein, refers to a change made in either an amino acid or nucleotide sequence resulting in the absence of one or more amino acids or nucleotides, respectively.

"Encapsidation", as used herein, refers to the process during virion assembly in which nucleic acid becomes incorporated in the viral capsid or in a head/capsid precursor (for example, in certain bacteriophages).

"Exon", as used herein, refers to a polynucleotide sequence in a nucleic acid that encodes information for protein synthesis and that is copied and spliced together with other such sequences to form messenger RNA.

"Expression", as used herein, is meant to incorporate transcription, reverse transcription, and translation.

"Expressed sequence tag (EST)" as used herein, refers to relatively short single-pass DNA sequences obtained from one or more ends of cDNA clones and RNA derived therefrom. They may be present in either the 5' or the 3' orientation. ESTs have been shown to be useful for identifying particular genes.

"Industrial crop", as used herein, refers to crops grown primarily for consumption by humans or animals or use in industrial processes (for example, as a source of fatty acids for manufacturing or sugars for producing alcohol). It will be understood that either the plant or a product produced from the plant (for example, sweeteners, oil, flour, or meal) can be consumed. Examples of food crops include, but are not limited to, corn, soybean, rice, wheat, oilseed rape, cotton, oats, barley, and potato plants.

"Foreign gene", as used herein, refers to any sequence that is not native to the virus.

"Fusion protein", as used herein, refers to a protein containing amino acid sequences from each of two distinct proteins; it is formed by the expression of a recombinant gene in which two coding sequences have been joined together such that their reading frames are in phase. Hybrid genes of this type may be constructed in vitro in order to label the product of a particular gene with a protein which can be more readily assayed (for example, a gene fused with lacZ in *E. coli* to obtain a fusion protein with β-galactosidase activity). Alternatively, a protein may be linked to a signal peptide to allow its secretion by the cell. The products of certain viral oncogenes are fusion proteins.

As used herein, the term "fractionated biological sample" refers to a biological sample that has been fractionated into two or more fractions based on one or more properties of the sample. For example, in some embodiments (see, for example, Example 19), leaf extracts are fractionated based on extraction with organic solvents.

"Gene", as used herein, refers to a discrete nucleic acid sequence responsible for a discrete cellular product. The term "gene", as used herein, refers not only to the nucleotide sequence encoding a specific protein, but also to any adjacent 5' and 3' non-coding nucleotide sequence involved in the regulation of expression of the protein encoded by the gene of interest. These non-coding sequences include terminator sequences, promoter sequences, upstream activator sequences, regulatory protein binding sequences, and the like. These non-coding sequence gene regions may be readily identified by comparison with previously identified eukaryotic non-coding sequence gene regions. Furthermore, the person of average skill in the art of molecular biology is able to identify the nucleotide sequences forming the non-coding regions of a gene using well-known techniques such as a site-directed mutagenesis, sequential deletion, promoter probe vectors, and the like.

"Growth cycle", as used herein, is meant to include the replication of a nucleus, an organelle, a cell, or an organism.

"Heterologous", as used herein, refers to the association of a molecular or genetic element associated with a distinctly different type of molecular or genetic element.

"Host", as used herein, refers to a cell, tissue or organism capable of replicating a vector or plant viral nucleic acid and which is capable of being infected by a virus containing the viral vector or plant viral nucleic acid. This term is intended to include prokaryotic and eukaryotic cells, organs, tissues or organisms, where appropriate.

As used herein, the term "homolog" as in a "homolog" of a given nucleic acid sequence, refers to a nucleic acid sequence (for example, a nucleic acid sequence from another organism), that shares a given degree of "homology" with the nucleic acid sequence.

The term "homology" refers to a degree of complementarity. There may be partial homology or complete homology (identity). A partially complementary sequence is one that at least partially inhibits a completely complementary sequence from hybridizing to a target nucleic acid and is referred to using the functional term "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (the hybridization) of a completely homologous sequence to a target under conditions of low stringency. This is not to say that conditions of low stringency are such that non-specific binding is permitted; low stringency conditions require that the binding of two sequences to one another be a specific (selective) interaction. The absence of non-specific binding may be tested by the use of a second target that lacks even a partial degree of complementarity (for example, less than about 30% identity); in the absence of non-specific binding the probe will not hybridize to the second non-complementary target.

Numerous equivalent conditions may be employed to comprise low stringency conditions; factors such as the length and nature (DNA, RNA, base composition) of the probe and nature of the target (DNA, RNA, base composition, present in solution or immobilized, etc.) and the concentration of the salts and other components (for example, the presence or absence of form amide, dextran sulfate, polyethylene glycol) are considered and the hybridization solution may be varied to generate conditions of low stringency hybridization different from, but equivalent to, the above listed conditions. In addition, the art knows conditions that promote hybridization under conditions of high stringency (for example, increasing the temperature of the hybridization and/or wash steps, the use of formamide in the hybridization solution, etc.).

When used in reference to a double-stranded nucleic acid sequence such as a cDNA or genomic clone, the term "substantially homologous" refers to any probe that can hybridize to either or both strands of the double-stranded nucleic acid sequence under conditions of low stringency as described above.

A gene may produce multiple RNA species that are generated by differential splicing of the primary RNA transcript. cDNAs that are splice variants of the same gene will contain regions of sequence identity or complete homology (representing the presence of the same exon or portion of the same exon on both cDNAs) and regions of complete non-identity (for example, representing the presence of exon "A" on cDNA 1 wherein cDNA 2 contains exon "B" instead). Because the two cDNAs contain regions of sequence identity they will both hybridize to a probe derived from the entire gene or portions of the gene containing sequences found on both cDNAs; the two splice variants are therefore substantially homologous to such a probe and to each other.

When used in reference to a single-stranded nucleic acid sequence, the term "substantially homologous" refers to any probe that can hybridize (it is the complement of) the single-stranded nucleic acid sequence under conditions of low stringency as described above.

As used herein, the term "hybridization" is used in reference to the pairing of complementary nucleic acids. Hybridization and the strength of hybridization (for example, the strength of the association between the nucleic acids) is impacted by such factors as the degree of complementary between the nucleic acids, stringency of the conditions involved, the $T_m$ of the formed hybrid, and the G:C ratio within the nucleic acids.

"Hybridization complex", as used herein, refers to a complex formed between nucleic acid strands by virtue of hydrogen bonding, stacking or other non-covalent interactions between bases. A hybridization complex may be formed in solution or between nucleic acid sequences present in solution and nucleic acid sequences immobilized on a solid support (for example, membranes, filters, chips, pins or glass slides to which cells have been fixed for in situ hybridization).

"Immunologically active" refers to the capability of a natural, recombinant, or synthetic polypeptide, or any oligopeptide thereof, to bind with specific antibodies and induce a specific immune response in appropriate animals or cells.

"Induction" and the terms "induce", "induction" and "inducible", as used herein, refer generally to a gene and a promoter operably linked thereto which is in some manner dependent upon an external stimulus, such as a molecule, in order to actively transcribed and/or translate the gene.

"Infection", as used herein, refers to the ability of a virus to transfer its nucleic acid to a host or introduce viral nucleic acid into a host, wherein the viral nucleic acid is replicated, viral proteins are synthesized, and new viral particles assembled. In this context, the terms "transmissible" and "infective" are used interchangeably herein.

As used herein, the term "insecticidally effective amount," when used in reference to a polypeptide, refers to the amount of polypeptide necessary to kill an insect or otherwise deter the feeding of an insect from the source which makes the polypeptide available to the insect. When an insect comes into contact with a insecticidally effective amount of a polypeptide delivered via transgenic plant expression, formulated compositions, sprayable protein compositions, a bait matrix or other delivery system, the results are typically death of the insect, or the insects do not feed upon the source which makes the toxins available to the insects.

"Insertion" or "addition", as used herein, refers to the replacement or addition of one or more nucleotides or amino acids, to a nucleotide or amino acid sequence, respectively.

"In cis", as used herein, indicates that two sequences are positioned on the same strand of RNA or DNA.

"In trans", as used herein, indicates that two sequences are positioned on different strands of RNA or DNA.

"Intron", as used herein, refers to a polynucleotide sequence in a nucleic acid that does not encode information for protein synthesis and is removed before translation of messenger RNA.

"Isolated", as used herein, refers to a polypeptide or polynucleotide molecule separated not only from other peptides, DNAs, or RNAs, respectively, that are present in the natural source of the macromolecule but also from other macromolecules and preferably refers to a macromolecule found in the presence of (if anything) only a solvent, buffer, ion or other component normally present in a solution of the same. "Isolated" and "purified" do not encompass either natural materials in their native state or natural materials that have been separated into components (for example, in an acrylamide gel) but not obtained either as pure substances or as solutions.

"Kinase", as used herein, refers to an enzyme (for example, hexokinase and pyruvate kinase) which catalyzes the transfer of a phosphate group from one substrate (commonly ATP) to another.

"Marker" or "genetic marker", as used herein, refer to a genetic locus which is associated with a particular, usually readily detectable, genotype or phenotypic characteristic (for example, an antibiotic resistance gene).

"Metabolome", as used herein, indicates the complement of relatively low molecular weight molecules that is present in a plant, plant part, or plant sample, or in a suspension or extract thereof. Examples of such molecules include, but are not limited to: acids and related compounds; mono-, di-, and tri-carboxylic acids (saturated, unsaturated, aliphatic and cyclic, aryl, alkaryl); aldo-acids, keto-acids; lactone forms; gibberellins; abscisic acid; alcohols, polyols, derivatives, and related compounds; ethyl alcohol, benzyl alcohol, methanol; propylene glycol, glycerol, phytol; inositol, furfuryl alcohol, menthol; aldehydes, ketones, quinones, derivatives, and related compounds; acetaldehyde, butyraldehyde, benzaldehyde, acrolein, furfural, glyoxal; acetone, butanone; anthraquinone; carbohydrates; mono-, di-, tri-saccharides; alkaloids, amines, and other bases; pyridines (including nicotinic acid, nicotinamide); pyrimidines (including cytidine, thymine); purines (including guanine, adenine, xanthines/hypoxanthines, kinetin); pyrroles; quinolines (including isoquinolines); morphinans, tropanes, cinchonans; nucleotides, oligonucleotides, derivatives, and related compounds; guanosine, cytosine, adenosine, thymidine, inosine; amino acids, oligopeptides, derivatives, and related compounds; esters; phenols and related compounds; heterocyclic compounds and derivatives; pyrroles, tetrapyrroles (corrinoids and porphines/porphyrins, w/w/o metalion); flavonoids; indoles; lipids (including fatty acids and triglycerides), derivatives, and related compounds; carotenoids, phytoene; and sterols, isoprenoids including terpenes.

"Modulate", as used herein, refers to a change or an alteration in the biological activity of a polypeptide (for example, a polypeptide encoded by a nucleic acid of the present invention). Modulation may be an increase or a decrease in protein activity, a change in binding characteristics, or any other change in the biological, functional or immunological properties of the polypeptide.

"Movement protein", as used herein, refers to a noncapsid protein required for cell to cell movement of replicons or viruses in plants.

"Multigene family", as used herein, refers to a set of genes descended by duplication and variation from some ancestral gene. Such genes may be clustered together on the same chromosome or dispersed on different chromosomes. Examples of multigene families include those which encode the histones, hemoglobins, immunoglobulins, histocompatibility antigens, actins, tubulins, keratins, collagens, heat shock proteins, salivary glue proteins, chorion proteins, cuticle proteins, yolk proteins, and phaseolins.

"Non-native", as used herein, refers to any RNA sequence that promotes production of subgenomic mRNA including, but not limited to, 1) plant viral promoters such as ORSV and brome mosaic virus, 2) viral promoters from other organisms such as human Sindbis viral promoter, and 3) synthetic promoters.

"Nucleic acid sequence", as used herein, refers to a polymer of nucleotides in which the 3' position of one nucleotide sugar is linked to the 5' position of the next by a phosphodiester bridge. In a linear nucleic acid strand, one end typically has a free 5' phosphate group, the other a free 3' hydroxyl group. Nucleic acid sequences may be used herein to refer to oligonucleotides, or polynucleotides, and fragments or portions thereof, and to DNA or RNA of genomic or synthetic origin which may be single- or double-stranded, and represent the sense or antisense strand.

"Polypeptide", as used herein, refers to an amino acid sequence obtained from any species and from any source whether natural, synthetic, semi-synthetic, or recombinant.

"Oil-producing species," as used herein, refers to plant species which produce and store triacylglycerol in specific organs, primarily in seeds. Such species include soybean (*Glycine max*), rapeseed and canola (including *Brassica napus* and *B. campestris*), sunflower (*Helianthus annus*), cotton (*Gossypium hirsutum*), corn (*Zea mays*), cocoa (*Theobroma cacao*), safflower (*Carthamus tinctorius*), oil palm (*Elaeis guineensis*), coconut palm (*Cocos nucifera*), flax (*Linum usitatissimum*), castor (*Ricinus communis*) and peanut (*Arachis hypogaea*). The group also includes non-agronomic species which are useful in developing appropriate expression vectors such as tobacco, rapid cycling *Brassica* species, and *Arabidopsis thaliana*, and wild species which may be a source of unique fatty acids.

"Operably linked" refers to a juxtaposition of components, particularly nucleotide sequences, such that the normal function of the components can be performed. Thus, a coding sequence that is operably linked to regulatory sequences refers to a configuration of nucleotide sequences wherein the coding sequences can be expressed under the regulatory control, that is, transcriptional and/or translational control, of the regulatory sequences.

"Origin of assembly", as used herein, refers to a sequence where self-assembly of the viral RNA and the viral capsid protein initiates to form virions.

As used herein, the term "ortholog" refers to genes that have evolved from an ancestral locus.

"Outlier peak", as used herein, indicates a peak of a chromatogram of a test sample, or the relative or absolute detected response data, or amount or concentration data thereof. An outlier peak: 1) may have a significantly different peak height or area as compared to a like chromatogram of a control sample; or 2) be an additional or missing peak as compared to a like chromatogram of a control sample.

As used herein, the term "overexpression" refers to the production of a gene product in transgenic organisms that exceeds levels of production in normal or non-transformed organisms.

As used herein, the term "cosuppression" refers to the expression of a foreign gene which has substantial homology to an endogenous gene resulting in the suppression of expression of both the foreign and the endogenous gene. As used herein, the term "altered levels" refers to the production of gene product(s) in transgenic organisms in amounts or portions that differ from that of normal or non-transformed organisms.

As used herein, the term "peak identification" refers to the identification of a chemical compound corresponding to a given peak. In some embodiments, peaks are identified by searching mass spectral libraries. In other embodiments, peaks are identified by searching additional libraries or databases (for example, biotechnology databases).

As used herein, the term "pesticidal activity" refers to a peptides function as orally active insect control agents, a toxic effect against pests or insects, or the ability to disrupt or deter insect feeding which may or may not cause death of the insect.

"Phenotype" or "phenotypic trait(s)", as used herein, refers to an observable property or set of properties resulting from the expression of a gene. "Visual phenotype", as used herein, refers to a plant displaying a symptom or group of symptoms that meet defined criteria. "Stunting phenotype", as used herein, refers to a phenotype where any stunting symptoms are present in any plant region. Stunting symptoms include reduced internodal length, reduced petiole length, reduced shoot apex length and reduced leaf blade diameter (along two axes). Other symptoms that are typically viral such as mild (level 2 severity code) chlorosis and blade curling may be present as well. If any additional symptoms such as necrosis, wilting or etching are present (excluding the inoculated leaves) at any level the plant does not fit the criteria for a stunting phenotype. "Altered metabolism phenotype" as used herein, refers to a phenotype wherein the production of a given metabolite is altered (for example, increased or decreased) in a plant. Examples of metabolites which can be altered in a plant include, but are not limited to, acids, fatty acids, amino acids, hydroxy fatty acids, branched fatty acids, carbohydrates, hydrocarbons, glycerides, phenols, strerols, oxygenated terpenes, and other isoprenoids, alcohols, alkenes and alkynes.

"Plant", as used herein, refers to any plant and progeny thereof. The term also includes parts of plants, including seed, cuttings, tubers, fruit, flowers, etc.

"Plant cell", as used herein, refers to the structural and physiological unit of plants, consisting of a protoplast and the cell wall.

"Plant organ", as used herein, refers to a distinct and visibly differentiated part of a plant, such as root, stem, leaf or embryo.

"Plant tissue", as used herein, refers to any tissue of a plant in planta or in culture. This term is intended to include a whole plant, plant cell, plant organ, protoplast, cell culture, or any group of plant cells organized into a structural and functional unit.

"Portion", as used herein, with regard to a protein ("a portion of a given protein") refers to fragments of that protein. The fragments may range in size from four amino acid residues to the entire amino acid sequence minus one amino acid (10 nucleotides, 20, 30, 40, 50, 100, 200, etc.). A "portion" is preferably at least 25 nucleotides, more preferably at least 50 nucleotides, and even more preferably at least 100 nucleotides.

"Positive-sense inhibition", as used herein, refers to a type of gene regulation based on cytoplasmic inhibition of gene expression due to the presence in a cell of an RNA molecule substantially homologous to at least a portion of the mRNA being translated.

"Production cell", as used herein, refers to a cell, tissue or organism capable of replicating a vector or a viral vector, but which is not necessarily a host to the virus. This term is intended to include prokaryotic and eukaryotic cells, organs, tissues or organisms, such as bacteria, yeast, fungus, and plant tissue.

"Promoter", as used herein, refers to the 5'-flanking, non-coding sequence adjacent a coding sequence which is involved in the initiation of transcription of the coding sequence.

"Protoplast", as used herein, refers to an isolated plant cell without cell walls, having the potency for regeneration into cell culture or a whole plant.

"Purified", as used herein, when referring to a peptide or nucleotide sequence, indicates that the molecule is present in the substantial absence of other biological macromolecular, for example, polypeptides, polynucleic acids, and the like of the same type. The term "purified" as used herein preferably means at least 95% by weight, more preferably at least 99.8% by weight, of biological macromolecules of the same type present (but water, buffers, and other small molecules, especially molecules having a molecular weight of less than 1000 can be present).

The term "pure", as used herein, preferably has the same numerical limits as "purified" immediately above. "Substantially purified", as used herein, refers to nucleic or amino acid sequences that are removed from their natural environment, isolated or separated, and are at least 60% free, preferably 75% free, and most preferably 90% free from other components with which they are naturally associated.

As used herein, the term "quantitative peak differentiation" refers to the process of confirming peak matched by calculating their relative quantitative differentiation, which is expressed as a percent change of the sample leak are relative to the area of the reference peak. A predetermined threshold of for the change is used to confirm that the peaks are a match.

"Recombinant plant viral nucleic acid", as used herein, refers to a plant viral nucleic acid which has been modified to contain non-native nucleic acid sequences. These normative nucleic acid sequences may be from any organism or purely synthetic, however, they may also include nucleic acid sequences naturally occurring in the organism into which the recombinant plant viral nucleic acid is to be introduced.

"Recombinant plant virus", as used herein, refers to a plant virus containing a recombinant plant viral nucleic acid.

As used herein, the term "reference sample" refers to a sample containing a plurality of known biological macromolecules.

"Regulatory region" or "regulatory sequence", as used herein, in reference to a specific gene refers to the non-coding nucleotide sequences within that gene that are necessary or sufficient to provide for the regulated expression of the coding region of a gene. Thus the term regulatory region includes promoter sequences, regulatory protein binding sites, upstream activator sequences, and the like. Specific nucleotides within a regulatory region may serve multiple functions. For example, a specific nucleotide may be part of a promoter and participate in the binding of a transcriptional activator protein.

"Replication origin", as used herein, refers to the minimal terminal sequences in linear viruses that are necessary for viral replication.

"Replicon", as used herein, refers to an arrangement of RNA sequences generated by transcription of a transgene that is integrated into the host DNA that is capable of replication in the presence of a helper virus. A replicon may require sequences in addition to the replication origins for efficient replication and stability.

As used herein, the term "resistance to insects," when used in reference to plants, refers to the ability of a plant to resist insects or other plants.

"Sample", as used herein, is used in its broadest sense. A biological sample suspected of containing nucleic acid encoding a polypeptide (for example, a polypeptide encoded by a nucleic acid of the present invention) or fragments thereof may comprise a tissue, a cell, an extract from cells, chromosomes isolated from a cell (for example, a spread of metaphase chromosomes), genomic DNA (in solution or bound to a solid support such as for Southern analysis), RNA (in solution or bound to a solid support such as for northern analysis), cDNA (in solution or bound to a solid support), and the like.

"Silent mutation", as used herein, refers to a mutation which has no apparent effect on the phenotype of the organism.

"Site-directed mutagenesis", as used herein, refers to the in-vitro induction of mutagenesis at a specific site in a given target nucleic acid molecule.

"Subgenomic promoter", as used herein, refers to a promoter of a subgenomic mRNA of a viral nucleic acid.

"Specific binding" or "specifically binding", as used herein, in reference to the interaction of an antibody and a protein or peptide, mean that the interaction is dependent upon the presence of a particular structure (the antigenic determinant or epitope) on the protein; in other words, the antibody is recognizing and binding to a specific protein structure rather than to proteins in general.

As used herein, the term "$T_m$" is used in reference to the "melting temperature." The melting temperature is the temperature at which a population of double-stranded nucleic acid molecules becomes half dissociated into single strands. The equation for calculating the $T_m$ of nucleic acids is well known in the art. As indicated by standard references, a simple estimate of the $T_m$ value may be calculated by the equation: $T_m=81.5+0.41(\% G+C)$, when a nucleic acid is in aqueous solution at 1 M NaCl (See for example, Anderson and Young, Quantitative Filter Hybridization, in *Nucleic Acid Hybridization* [1985]). Other references include more sophisticated computations that take structural as well as sequence characteristics into account for the calculation of $T_m$.

As used herein, the term "stringency" is used in reference to the conditions of temperature, ionic strength, and the presence of other compounds such as organic solvents, under which nucleic acid hybridizations are conducted. Those skilled in the art will recognize that "stringency" conditions may be altered by varying the parameters just described either individually or in concert. With "high stringency" conditions, nucleic acid base pairing will occur only between nucleic acid fragments that have a high frequency of complementary base sequences (for example, hybridization under "high stringency" conditions may occur between homologs with about 85-100% identity, preferably about 70100% identity). With medium stringency conditions, nucleic acid base pairing will occur between nucleic acids with an intermediate frequency of complementary base sequences (for example, hybridization under "medium stringency" conditions may occur between homologs with about 50-70% identity). Thus, conditions of "weak" or "low" stringency are often required with nucleic acids that are derived from organisms that are genetically diverse, as the frequency of complementary sequences is usually less.

"High stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.5% SDS, 5× Denhardt's reagent and 100 µg/ml denatured salmon sperm DNA followed by washing in a solution comprising 0.1× SSPE, 1.0% SDS at 42° C. when a probe of about 500 nucleotides in length is employed.

"Medium stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.5% SDS, 5× Denhardt's reagent and 100 µg/ml denatured salmon sperm DNA followed by washing in a solution comprising 1.0× SSPE, 1.0% SDS at 42° C. when a probe of about 500 nucleotides in length is employed.

"Low stringency conditions" comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.1% SDS, 5× Denhardt's reagent [50× Denhardt's contains per 500 ml: 5 g Ficoll (Type 400, Pharamcia), 5 g BSA (Fraction V; Sigma)] and 100 g/ml denatured salmon sperm DNA followed by washing in a solution comprising 5×SSPE, 0.1% SDS at 42° C. when a probe of about 500 nucleotides in length is employed.

"Substitution", as used herein, refers to a change made in an amino acid of nucleotide sequence which results in the replacement of one or more amino acids or nucleotides by different amino acids or nucleotides, respectively.

As used herein, the term "susceptibility to insects," when used in reference to plants, refers the extent that a plant is subject to damage by insects or other plants.

"Symptom", as used herein refers to a visual condition resulting from the action of the GENEWARE™ vector or the clone insert.

"Systemic infection", as used herein, denotes infection throughout a substantial part of an organism including mechanisms of spread other than mere direct cell inoculation but rather including transport from one infected cell to additional cells either nearby or distant.

As used herein, the term "tolerance to insects," when used in reference to plants, refers to the ability of a plant to withstand damage caused by pests or insects.

"Transcription", as used herein, refers to the production of an RNA molecule by RNA polymerase as a complementary copy of a DNA sequence.

"Transcription termination region", as used herein, refers to the sequence that controls formation of the 3' end of the transcript. Self-cleaving ribozymes and polyadenylation sequences are examples of transcription termination sequences.

"Transformation", as used herein, describes a process by which exogenous DNA enters and changes a recipient cell. It may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time.

The term "transfection", as used herein, refers to the introduction of foreign DNA into eukaryotic cells. Transfection may be accomplished by a variety of means known to the art including calcium phosphate-DNA co-precipitation, DEAE-dextran-mediated transfection, polybrene-mediated transfection, electroporation, microinjection, liposome fusion, lipofection, protoplast fusion, retroviral infection, and biolistics.

"Transposon", as used herein, refers to a nucleotide sequence such as a DNA or RNA sequence which is capable of transferring location or moving within a gene, a chromosome or a genome.

"Transgenic plant", as used herein, refers to a plant which contains a foreign nucleotide sequence inserted into either its nuclear genome or organellar genome.

"Transgene", as used herein, refers to the DNA sequence coding for the replicon that is inserted into the host DNA.

As used herein, the term "two-dimensional peak matching" refers to the pairing or matching of peaks in reference and fractionated biological samples. Peaks are first paired based on their retention index. A match is then confirmed by spectral matching.

"Variants" of a polypeptide (for example, a polypeptide encoded by a nucleic acid of the present invention), as used herein, refers to a sequence resulting when a polypeptide is altered by one or more amino acids. The variant may have "conservative" changes, wherein a substituted amino acid has similar structural or chemical properties, for example, replacement of leucine with isoleucine. More rarely, a variant may have "nonconservative" changes, for example, replacement of a glycine with a tryptophan. Variants may also include sequences with amino acid deletions or insertions, or both. Guidance in determining which amino acid residues may be substituted, inserted, or deleted without abolishing biological or immunological activity may be found using computer programs well known in the art.

"Vector", as used herein, refers to a self-replicating DNA or RNA molecule which transfers a nucleic acid segment between cells.

"Virion", as used herein, refers to a particle composed of viral RNA and viral capsid protein.

"Virus", as used herein, refers to an infectious agent composed of a nucleic acid encapsidated in a protein. A virus may be a mono-, di-, tri- or multipartite virus.

DESCRIPTION OF THE INVENTION

A number of chemical compounds have been identified by others that cause dwarfing or stunting of plants (for example, U.S. Pat. Nos. 4,045,459; 3,931,235; 3,947,264; and 3,818,046). However, the use of many of these chemical compounds in environmental settings is limited by their potential toxicity. Use of the nucleic acids and constructs described herein to dwarf or stunt plants avoids the problems associated with the release of toxic chemicals into the environment.

Accordingly, the present invention provides nucleic acid sequences that, when expressed in plants, cause stunting of plant growth. The present invention is not limited to a particular mechanism of action. Indeed, an understanding of the mechanism of action is necessary to practice the present invention. However, it is contemplated that the stunting phenotype is caused by either overexpression, antisense inhibition, or cosuppression mediated by expression of the nucleic sequence.

Genes that are demonstrated to effect growth regulation of the plant (stunting, elongation, etc) are useful for a number of purposes, including, but not limited to the following: a) Creation of dwarf varieties of any plant species; b) Creation of plants that have controlled meristematic growth such that a desired plant height or plant form is achieved; c) Creation of plants that have a lengthened vegetative phase of plant development to achieve increased plant mass and yield; d) Creation of plants that have a shortened vegetative phase of plant development to achieve yields in a short growing season; and e) Creation of plants that undergo senescence or programmed death at a desired time.

I. Identification of Nucleotide and Amino Acid Sequences

The invention is based on the discovery of putative known and unknown deoxyribose nucleic acid (DNA) and amino acid sequences identified in one or more metabolic pathways that lead to dwarfism and stunting in plants and the use of these sequences in agriculture to create dwarf varieties of any plant species.

Nucleic acids encoding the polypeptides of the present invention were first identified in Biosource clones generated from an ABRC cDNA library. The cDNA library had been constructed in the GENEWARE vector. The GENEWARE vector is described in U.S. application Ser. No. 09/008,186. Each of the complete set of clones from the GENEWARE library were used to prepare an infectious viral unit. An infectious unit corresponding to each clone was used to inoculate Nicotiana benthamiana (a dicotyledonous plant). The plants were grown under identical conditions and a phenotypic analysis of each plant was carried out. The stunting and dwarfing phenotype was observed in the plants that had been infected by infectious unit created from the nucleic acids of the present invention. In other embodiments, sequences causing an altered metabolism phenotype were identified.

Following the identification of the stunting phenotype in plant samples, further biochemical analyses of the infected plant s tissue were carried out. Function was ascertained by a determination of at least one variation produced in the metabolome of the infected plant using the analytical methodologies and data processing techniques described in the Examples section below. The nucleotide sequences of the present invention were analyzed using bioinformatics methods as described below.

II. Bioinformatics Methods

A. Phred, Phrap and Consed

Phred, Phrap and Consed are a set of programs which read DNA sequencer traces, make base calls, assemble the shotgun DNA sequence data and analyze the sequence regions that are likely to contribute to errors. Phred is the initial program used to read the sequencer trace data, call the bases and assign quality values to the bases. Phred uses a Fourier-based method to examine the base traces generated by the sequencer. The output files from Phred are written in FASTA, phd or scf format. Phrap is used to assemble contiguous sequences from only the highest quality portion of the sequence data output by Phred. Phrap is amenable to high-throughput data collection. Finally, Consed is used as a finishing tool to assign error probabilities to the sequence data. Detailed description of the Phred, Phrap and Consed software and its use can be found in the following references: Ewing et al., Genome Res., 8:175 [1998]; Ewing and Green, Genome Res. 8:186 [1998]; Gordon et al., Genome Res. 8: 195 [1998].

B. BLAST

The BLAST set of programs may be used to compare the large numbers of sequences and obtain homologies to known protein families. These homologies provide information regarding the function of newly sequenced genes. Detailed description of the BLAST software and its uses can be found in the following references Altschul et al., J. Mol. Biol., 215:403 [1990]; Altschul, J. Mol. Biol. 219:555 [1991].

Generally, BLAST performs sequence similarity searching and is divided into 5 basic subroutines: (1) BLASTP compares an amino acid sequence to a protein sequence database; (2) BLASTN compares a nucleotide sequence to a nucleic acid sequence database; (3) BLASTX compares translated protein sequences done in 6 frames to a protein sequence database; (4) TBLASTN compares a protein sequence to a nucleotide sequence database that is translated into all 6 reading frames; (5) TBLASTX compares the 6 frame translated protein sequence to the 6-frame translation of a nucleotide sequence database. Subroutines (3)-(5) may be used to identify weak similarities in nucleic acid sequence.

The BLAST program is based on the High Segment Pair (HSP), two sequence fragments of arbitrary but equal length whose alignment is locally maximized and whose alignment meets or exceeds a cutoff threshold. BLAST determines multiple HSP sets statistically using sum statistics. The score of the HSP is then related to its expected chance of frequency of occurrence, E. The value, E, is dependent on several factors such as the scoring system, residue composition of sequences, length of query sequence and total length of database. In the output file will be listed these E values, these are typically in a histogram format, and are useful in determining levels of statistical significance at the user s predefined expectation threshold. Finally, the Smallest Sum Probability, P(N) is the probability of observing the shown matched sequences by chance alone and is typically in the range of 0-1.

BLAST measures sequence similarity using a matrix of similarity scores for all possible pairs of residues and these specify scores for aligning pairs of amino acids. The matrix of choice for a specific use depends on several factors: the length of the query sequence and whether or not a close or distant relationship between sequences is suspected. Several matrices are available including PAM40, PAM120, PAM250, BLOSUM 62 and BLOSUM 50. Altschul et al. (1990) found PAM120 to be the most broadly sensitive matrix (for example point accepted mutation matrix per 100 residues). However, in some cases the PAM120 matrix may not find short but strong or long but weak similarities between sequences. In these cases, pairs of PAM matrices may be used, such as PAM40 and PAM 250, and the results compared. Typically, PAM 40 is used for database searching with a query of 9-21 residues long, while PAM 250 is used for lengths of 47-123.

The BLOSUM (Blocks Substitution Matrix) series of matrices are constructed based on percent identity between two sequence segments of interest. Thus, the BLOSUM62 matrix is based on a matrix of sequence segments in which the members are less than 62% identical. BLOSUM62 shows very good performance for BLAST searching. However, other BLOSUM matrices, like the PAM matrices, may be useful in other applications. For example, BLOSUM45 is particularly strong in profile searching.

C. FASTA

The FASTA suite of programs permits the evaluation of DNA and protein similarity based on local sequence alignment. The FASTA search algorithm utilizes Smith/Waterman- and Needleman/Wunsch-based optimization methods. These algorithms consider all of the alignment possibilities between the query sequence and the library in the highest-scoring sequence regions. The search algorithm proceeds in four basic steps:

1. The identities or pairs of identities between the two DNA or protein sequences are determined. The ktup parameter, as set by the user, is operative and determines how many consecutive sequence identities are required to indicate a match.
2. The regions identified in step 1 are re-scored using a PAM or BLOSUM matrix. This allows conservative replacements and runs of identities shorter than that specified by ktup to contribute to the similarity score.
3. The region with the single best scoring initial region is used to characterize pairwise similarity and these scores are used to rank the library sequences.
4. The highest scoring library sequences are aligned using the Smith-Waterman algorithm.

This final comparison takes into account the possible alignments of the query and library sequence in the highest scoring region.

Further detailed description of the FASTA software and its use can be found in the following reference: Pearson and Lipman, Proc. Natl. Acad. Sci., 85: 2444 [1988].

D. Pfam

Despite the large number of different protein sequences determined through genomics-based approaches, relatively few structural and functional domains are known. Pfam is a computational method that utilizes a collection of multiple alignments and profile hidden Markov models of protein domain families to classify existing and newly found protein sequences into structural families. Detailed description of the Pfam software and its uses can be found in the following references: Sonhammer et al., Proteins: Structure, Function and Genetics, 28:405 [1997]; Sonhammer et al., Nucleic Acids Res., 26:320 [1998]; Bateman et al., Nucleic Acids Res., 27: 260 [1999].

Pfam 3.1, the latest version, includes 54% of proteins in SWISS_PROT and SP-TrEMBL-5 as a match to the database and includes expectation values for matches. Pfam consists of parts A and B. Pfam-A contains a hidden Markov model and includes curated families. Pfam-B uses the Domainer program to cluster sequence segments not included in Pfam-A. Domainer uses pairwise homology data from Blastp to construct aligned families.

Alternative protein family databases that may be used include PRINTS and BLOCKS, which both are based on a set of ungapped blocks of aligned residues. However, these programs typically contain short conserved regions whereas Pfam represents a library of complete domains that facilitates automated annotation. Comparisons of Pfam profiles may also be performed using genomic and EST data with the programs, Genewise and ESTwise, respectively. Both of these programs allow for introns and frame shifting errors.

E. BLOCKS

The determination of sequence relationships between unknown sequences and those that have been categorized can be problematic because background noise increases with the number of sequences, especially at a low level of similarity detection. One recent approach to this problem has been tested that efficiently detects and confirms weak or distant relationships among protein sequences based on a database of blocks. The BLOCKS database provides multiple alignments of sequences and contains blocks or protein motifs found in known families of proteins.

Other programs such as PRINTS and Prodom also provide alignments, however, the BLOCKS database differs in the manner in which the database was constructed. Construction of the BLOCKS database proceeds as follows: one starts with a group of sequences that presumably have one or motifs in common, such as those from the PROSITE database. The PROTOMAT program then uses a motif finding program to scan sequences for similarity looking for spaced triplets of amino acids. The located blocks are then entered into the MOTOMAT program for block assembly. Weights are computed for all sequences. Following construction of a BLOCKS database one can use BLIMPS to performs searches of the BLOCKS database. Detailed description of the construction and use of a BLOCKS database can be found in the following references: Henikoff, S. and Henikoff, J. G., Genomics, 19:97 [1994]; Henikoff, J. G. and Henikoff, S., Meth. Enz., 266:88 [1996].

F. PRINTS

The PRINTS database of protein family fingerprints can be used in addition to BLOCKS and PROSITE. These databases are considered to be secondary databases because they diagnose the relationship between sequences that yield function information. Presently, however, it is not recommended that these databases be used alone. Rather, it is strongly suggested that these pattern databases be used in conjunction with each other so that a direct comparison of results can be made to analyze their robustness.

Generally, these programs utilize pattern recognition to discover motifs within protein sequences. However, PRINTS goes one step further, it takes into account not simply single motifs but several motifs simultaneously that might characterize a family signature. Other programs, such as PROSITE, rely on pattern recognition but are limited by the fact that query sequences must match them exactly. Thus, sequences that vary slightly will be missed. In contrast, the PRINTS database fingerprinting approach is capable of identifying distant relatives due to its reliance on the fact that sequences do not have match the query exactly. Instead they are scored according to how well they fit each motif in the signature. Another advantage of PRINTS is that it allows the user to search both PRINTS and PROSITE simultaneously. A detailed description of the use of PRINTS can be found in the following reference: Attwood et al., Nucleic Acids Res. 25: 212 [1997].

III. Nucleic Acid Sequences, Including Related, Variant, Altered and Extended Sequences The invention encompasses nucleic acids, polypeptides encoded by the nucleic acid sequences, and polypeptide (for example, a polypeptide encoded by a nucleic acid of the present invention) variants that retain the biological or other functional activity of the polypeptide of interest. A preferred polypeptide variant is one having at least 80%, and more preferably 90%, amino acid sequence identity to the amino acid sequence of interest. A most preferred polypeptide variant is one having at least 95% amino acid sequence identity to the polypeptide of interest.

In particularly preferred embodiments, the invention encompasses the polynucleotides comprising SEQ ID NOs: 1-571. In particularly preferred embodiments, the nucleic acids are operably linked to an exogenous promoter (and in most preferred embodiments to a plant promoter) or present in a vector.

It will be appreciated by those skilled in the art that as a result of the degeneracy of the genetic code, a multitude of nucleotide sequences encoding a given polypeptide (for example, a polypeptide encoded by a nucleic acid of the present invention), some bearing minimal homology to the nucleotide sequences of any known and naturally occurring gene, may be produced. Thus, the invention contemplates each and every possible variation of nucleotide sequence that could be made by selecting combinations based on possible codon choices. These combinations are made in accordance with the standard triplet genetic code as applied to the nucleotide sequence of the naturally occurring polypeptide, and all such variations are to be considered as being specifically disclosed.

Although nucleotide sequences which encode a given polypeptide (for example, a polypeptide encoded by a nucleic acid of the present invention) and its variants are preferably capable of hybridizing to the nucleotide sequence of the naturally occurring polypeptide under appropriately selected conditions of stringency, it may be advantageous to produce nucleotide sequences encoding the polypeptide or its derivatives possessing a substantially different codon usage. Codons may be selected to increase the rate at which expression of the peptide occurs in a particular prokaryotic or eukaryotic host in accordance with the frequency with which particular codons are utilized by the host. Other reasons for substantially altering the nucleotide sequence encoding a polypeptide and its derivatives without altering the encoded amino acid sequences include the production of RNA transcripts having more desirable properties, such as a greater half-life, than transcripts produced from the naturally occurring sequence.

The invention also encompasses production of DNA sequences, or portions thereof, which encode a polypeptide and its derivatives, entirely by synthetic chemistry. After production, the synthetic sequence may be inserted into any of the many available expression vectors and cell systems using reagents that are well known in the art. Moreover, synthetic chemistry may be used to introduce mutations into a sequence encoding a polypeptide (for example, a polypeptide encoded by a nucleic acid of the present invention) or any portion thereof.

Also encompassed by the invention are polynucleotide sequences that are capable of hybridizing to SEQ ID NOs: 1-571 under various conditions of stringency (for example, low to high stringency). Hybridization conditions are based on the melting temperature $T_m$ of the nucleic acid binding complex or probe, as taught in Wahl and Berger, Methods Enzymol., 152:399 [1987] and Kimmel Methods Enzymol., 152:507 [1987], and may be used at a defined stringency.

Altered nucleic acid sequences encoding a polypeptide include deletions, insertions, or substitutions of different nucleotides resulting in a polynucleotide that encodes the same or a functionally equivalent polypeptide. The encoded protein may also contain deletions, insertions, or substitutions of amino acid residues which produce a silent change and result in a functionally equivalent polypeptide. Deliberate amino acid substitutions may be made on the basis of similarity in polarity, charge, solubility, hydrophobicity, hydrophilicity, and/or the amphipathic nature of the residues as long as the biological activity of the polypeptide is retained. For example, negatively charged amino acids may include aspartic acid and glutamic acid; positively charged amino acids may include lysine and arginine; and amino acids with uncharged polar head groups having similar hydrophilicity values may include leucine, isoleucine, and valine; glycine and alanine; asparagine and glutamine; serine and threonine; phenylalanine and tyrosine.

Also included within the scope of the present invention are alleles of the genes encoding polypeptides. As used herein, an "allele" or "allelic sequence" is an alternative form of the gene which may result from at least one mutation in the nucleic acid sequence. Alleles may result in altered mRNAs or polypeptides whose structure or function may or may not be altered. Any given gene may have none, one, or many allelic forms. Common mutational changes which give rise to alleles are generally ascribed to natural deletions, additions, or substitutions of nucleotides. Each of these types of changes may occur alone, or in combination with the others, one or more times in a given sequence.

Methods for DNA sequencing which are well known and generally available in the art may be used to practice any embodiments of the invention. The methods may employ such enzymes as the Klenow fragment of DNA polymerase I, SEQUENASE (US Biochemical Corporation, Cleveland, Ohio), TAQ polymerase (U.S. Biochemical Corporation, Cleveland, Ohio), thermostable T7 polymerase (Amersham Pharmacia Biotech, Chicago, Ill.), or combinations of recombinant polymerases and proofreading exonucleases such as the ELONGASE amplification system (Life Technologies, Rockville, Md.). Preferably, the process is automated with machines such as the MICROLAB 2200 (Hamilton Company, Reno, Nev.), PTC200 DNA Engine thermal cycler (MJ Research, Watertown, Mass.) and the ABI 377 DNA sequencer (Perkin Elmer).

The nucleic acid sequences encoding a polypeptide (for example, a polypeptide encoded by a nucleic acid of the present invention) may be extended utilizing a partial nucleotide sequence and employing various methods known in the art to detect upstream sequences such as promoters and regulatory elements. For example, one method which may be employed, "restriction-site" PCR, uses universal primers to retrieve unknown sequence adjacent to a known locus (Sarkar, PCR Methods Applic. 2:31S [1993]). In particular, genomic DNA is first amplified in the presence of primer to linker sequence and a primer specific to the known region. The amplified sequences are then subjected to a second round of PCR with the same linker primer and another specific primer internal to the first one. Products of each round of PCR are transcribed with an appropriate RNA polymerase and sequenced using reverse transcriptase.

Inverse PCR may also be used to amplify or extend sequences using divergent primers based on a known region (Triglia et al., Nucleic Acids Res. 16:8186 [1988]). The primers may be designed using OLIGO 4.06 primer analysis software (National Biosciences Inc., Plymouth, Minn.), or another appropriate program, to be 22-30 nucleotides in length, to have a GC content of 50% or more, and to anneal to the target sequence at temperatures about 68-72 C. The method uses several restriction enzymes to generate a suitable fragment in the known region of a gene. The fragment is then circularized by intramolecular ligation and used as a PCR template.

Another method which may be used is capture PCR which involves PCR amplification of DNA fragments adjacent to a known sequence in human and yeast artificial chromosome DNA (Lagerstrom et al., PCR Methods Applic. 1:111 [1991]). In this method, multiple restriction enzyme digestions and ligations may also be used to place an engineered double-stranded sequence into an unknown portion of the DNA molecule before performing PCR.

Another method which may be used to retrieve unknown sequences is that of Parker et al., Nucleic Acids Res., 19:3055 [1991]. Additionally, one may use PCR, nested primers, and PROMOTERFINDER DNA Walking Kits libraries (Clontech, Palo Alto, Calif.) to walk in genomic DNA. This process avoids the need to screen libraries and is useful in finding intron/exon junctions.

When screening for full-length cDNAs, it is preferable to use libraries that have been size-selected to include larger cDNAs. Also, random-primed libraries are preferable, in that they will contain more sequences which contain the 5' regions of genes. Use of a randomly primed library may be especially preferable for situations in which an oligo d(T) library does not yield a full-length cDNA. Genomic libraries may be useful for extension of sequence into the 5' and 3' non-transcribed regulatory regions.

Capillary electrophoresis systems which are commercially available (for example, from PE Biosystems, Inc., Foster City, Calif.) may be used to analyze the size or confirm the nucleotide sequence of sequencing or PCR products. In particular, capillary sequencing may employ flowable polymers for electrophoretic separation, four different fluorescent dyes (one for each nucleotide) which are laser activated, and detection of the emitted wavelengths by a charge coupled device camera. Output/light intensity may be converted to electrical signal using appropriate software (for example, GENOTYPER and SEQUENCE NAVIGATOR from PE Biosystems, Foster City, Calif.) and the entire process from loading of samples to computer analysis and electronic data display may be computer controlled. Capillary electrophoresis is especially preferable for the sequencing of small pieces of DNA which might be present in limited amounts in a particular sample.

It is contemplated that the nucleic acids disclosed herein can be utilized as starting nucleic acids for directed evolution. In some embodiments, artificial evolution is performed by random mutagenesis (for example, by utilizing error-prone PCR to introduce random mutations into a given coding sequence). This method requires that the frequency of mutation be finely tuned. As a general rule, beneficial mutations are rare, while deleterious mutations are common. This is because the combination of a deleterious mutation and a beneficial mutation often results in an inactive enzyme. The ideal number of base substitutions for targeted gene is usually between 1.5 and 5 (Moore and Arnold, Nat. Biotech., 14, 458-67 [1996]; Leung et al., Technique, 1:11-15 [1989]; Eckert and Kunkel, PCR Methods Appl., 1:17-24 [1991]; Caldwell and Joyce, PCR Methods Appl., 2:28-33 (1992); and Zhao and Arnold, Nuc. Acids. Res., 25:1307-08 [1997]). After mutagenesis, the resulting clones are selected for desirable activity. Successive rounds of mutagenesis and selection are often necessary to develop enzymes with desirable properties. It should be noted that only the useful mutations are carried over to the next round of mutagenesis.

In other embodiments of the present invention, the polynucleotides of the present invention are used in gene shuffling or sexual PCR procedures (for example, Smith, Nature, 370:324-25 [1994]; U.S. Pat. Nos. 5,837,458; 5,830,721; 5,811,238; and 5,733,731). Gene shuffling involves random fragmentation of several mutant DNAs followed by their reassembly by PCR into full length molecules. Examples of various gene shuffling procedures include, but are not limited to, assembly following DNase treatment, the staggered extension process (STEP), and random priming in vitro recombination. In the DNase mediated method, DNA segments isolated from a pool of positive mutants are cleaved into random fragments with DNaseI and subjected to multiple rounds of PCR with no added primer. The lengths of random fragments approach that of the uncleaved segment as the PCR cycles proceed, resulting in mutations in present in different clones becoming mixed and accumulating in some of the resulting sequences. Multiple cycles of selection and shuffling have led to the functional enhancement of several enzymes (Stemmer, Nature, 370:398-91 [1994]; Stemmer, Proc. Natl. Acad. Sci. USA, 91, 10747-51 [1994]; Crameri et al., Nat. Biotech., 14:315-19 [1996]; Zhang et al., Proc. Natl. Acad. Sci. USA, 94:4504-09 [1997]; and Crameri et al., Nat. Biotech., 15:436-38 [1997]).

IV. Vectors, Engineering, and Expression of Sequences

In another embodiment of the invention, polynucleotide sequences or fragments thereof which encode polypeptides, or fusion proteins or functional equivalents thereof, may be used in recombinant DNA molecules to direct expression of a polypeptide in appropriate host cells. Due to the inherent degeneracy of the genetic code, other DNA sequences which encode substantially the same or a functionally equivalent amino acid sequence may be produced and these sequences may be used to clone and express polypeptides (for example, a polypeptide encoded by a nucleic acid of the present invention).

As will be understood by those of skill in the art, it may be advantageous to produce nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

The nucleotide sequences of the present invention can be engineered using methods generally known in the art in order to alter the polypeptide sequences for a variety of reasons, including but not limited to, alterations which modify the cloning, processing, and/or expression of the gene product. DNA shuffling by random fragmentation and PCR reassembly of gene fragments and synthetic oligonucleotides may be used to engineer the nucleotide sequences. For example, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences encoding a polypeptide may be ligated to a heterologous sequence to encode a fusion protein. For example, to screen peptide libraries for inhibitors of the polypeptides activity (for example, enzymatic activity), it may be useful to encode a chimeric protein that can be recognized by a commercially available antibody. A fusion protein may also be engineered to contain a cleavage site located between the polypeptide encoding sequence and the heterologous protein sequence, so that the polypeptide of interest may be cleaved and purified away from the heterologous moiety.

In another embodiment, sequences encoding a polypeptide (for example, a polypeptide encoded by a nucleic acid of the present invention) may be synthesized, in whole or in part, using chemical methods well known in the art (See for example, Caruthers et al., Nucl. Acids Res. Symp. Ser. 215 [1980]; Hom et al., Nucl. Acids Res. Symp. Ser. 225 [1980]). Alternatively, the protein itself may be produced using chemical methods to synthesize the amino acid sequence of the polypeptide of interest (for example, a polypeptide encoded by a nucleic acid of the present invention), or a portion thereof. For example, peptide synthesis can be performed using various solid-phase techniques (Roberge et al., Science 269:202 [1995]) and automated synthesis may be achieved, for example, using the ABI 431A peptide synthesizer (PE Corporation, Norwalk, Conn.).

The newly synthesized peptide may be substantially purified by preparative high performance liquid chromatography (See for example, Creighton, T. (1983) Proteins, Structures and Molecular Principles, WH Freeman and Co., New York, N.Y.). The composition of the synthetic peptides may be confirmed by amino acid analysis or sequencing (for example, the Edman degradation procedure; or Creighton, supra). Additionally, the amino acid sequence of the polypeptide of interest or any part thereof, may be altered during direct synthesis and/or combined using chemical methods with sequences from other proteins, or any part thereof, to produce a variant polypeptide.

In order to express a biologically active polypeptide (for example, a polypeptide encoded by a nucleic acid of the present invention), the nucleotide sequences encoding the polypeptide or functional equivalents, may be inserted into appropriate expression vector, that is, a vector which contains the necessary elements for the transcription and translation of the inserted coding sequence.

Methods which are well known to those skilled in the art may be used to construct expression vectors containing sequences encoding polypeptides (for example, a polypeptide encoded by a nucleic acid of the present invention) and appropriate transcriptional and translational control elements. These methods include in vitro recombinant DNA techniques, synthetic techniques, and in vivo genetic recombination. Such techniques are described in Sambrook. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York, N.Y.

A variety of expression vector/host systems may be utilized to contain and express sequences encoding a polypeptide of interest. These include, but are not limited to, microorganisms such as bacteria transformed with recombinant bacteriophage, plasmid, or cosmid DNA expression vectors; yeast transformed with yeast expression vectors; insect cell systems infected with virus expression vectors (for example, baculovirus); plant cell systems transformed with virus expression vectors (for example, cauliflower mosaic virus, CaMV; tobacco mosaic virus, TMV; brome mosaic virus) or with bacterial expression vectors (for example, Ti or pBR322 plasmids); or animal cell systems.

The "control elements" or "regulatory sequences" are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the BLUESCRIPT phagemid (Stratagene, LaJolla, Calif.) or PSPORT1 plasmid (Life Technologies, Inc., Rockville, Md.) and the like may be used. The baculovirus polyhedrin promoter may be used in insect cells. Promoters or enhancers derived from the genomes of plant cells (for example, heat shock, RUBISCO; and storage protein genes) or from plant viruses (for example, viral promoters or leader sequences) may be cloned into the vector. In mammalian cell systems, promoters from mammalian genes or from mammalian viruses are preferable. If it is necessary to generate a cell line that contains multiple copies of the sequence encoding a polypeptide, vectors based on SV40 or EBV may be used with an appropriate selectable marker.

In bacterial systems, a number of expression vectors may be selected depending upon the use intended for the polypeptide of interest. For example, when large quantities of the polypeptide are needed for the induction of antibodies, vectors which direct high level expression of fusion proteins that are readily purified may be used. Such vectors include, but are not limited to, the multifunctional *E. coli* cloning and expression vectors such as BLUESCRIPT phagemid (Stratagene, La Jolla, Calif.), in which the sequence encoding the polypeptide of interest may be ligated into the vector in frame with sequences for the amino-terminal Met and the subsequent 7 residues of beta-galactosidase so that a hybrid protein is produced; pIN vectors (Van Heeke and Schuster, J. Biol. Chem. 264:5503 [1989]; and the like. pGEMX vectors (Promega Corporation, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast *Saccharomyces cerevisiae*, a number of vectors containing constitutive or inducible promoters such as alpha factor, alcohol oxidase, and PGH may be used. For reviews, See for example, Ausubel et al. (supra) and Grant et al., Methods Enzymol. 153:516 [1987].

In cases where plant expression vectors are used, the expression of sequences encoding polypeptides may be driven by any of a number of promoters. In a preferred embodiment, plant vectors are created using a recombinant plant virus containing a recombinant plant viral nucleic acid, as described in PCT publication WO 96/40867. Subsequently, the recombinant plant viral nucleic acid which contains one or more non-native nucleic acid sequences may be transcribed or expressed in the infected tissues of the plant host and the product of the coding sequences may be recovered from the plant, as described in WO 99/36516.

An important feature of this embodiment is the use of recombinant plant viral nucleic acids which contain one or more non-native subgenomic promoters capable of transcribing or expressing adjacent nucleic acid sequences in the plant host and which result in replication and local and/or systemic spread in a compatible plant host. The recombinant plant viral nucleic acids have substantial sequence homology to plant viral nucleotide sequences and may be derived from an RNA, DNA, cDNA or a chemically synthesized RNA or DNA. A partial listing of suitable viruses is described below.

The first step in producing recombinant plant viral nucleic acids according to this particular embodiment is to modify the nucleotide sequences of the plant viral nucleotide sequence by known conventional techniques such that one or more non-native subgenomic promoters are inserted into the plant viral nucleic acid without destroying the biological function of the plant viral nucleic acid. The native coat protein coding sequence may be deleted in some embodiments, placed under the control of a non-native subgenomic promoter in other embodiments, or retained in a further embodiment. If it is deleted or otherwise inactivated, a non-native coat protein gene is inserted under control of one of the non-native subgenomic promoters, or optionally under control of the native coat protein gene subgenomic promoter. The non-native coat protein is capable of encapsidating the recombinant plant viral nucleic acid to produce a recombinant plant virus. Thus, the recombinant plant viral nucleic acid contains a coat protein coding sequence, which may be native or a normative coat protein coding sequence, under control of one of the native or non-native subgenomic promoters. The coat protein is involved in the systemic infection of the plant host.

Some of the viruses which meet this requirement include viruses from the tobamovirus group such as Tobacco Mosaic virus (TMV), Ribgrass Mosaic Virus (RGM), Cowpea Mosaic virus (CMV), Alfalfa Mosaic virus (AMV), Cucumber Green Mottle Mosaic virus watermelon strain (CGMMV-W) and Oat Mosaic virus (OMV) and viruses from the brome mosaic virus group such as Brome Mosaic virus (BMV), broad bean mottle virus and cowpea chlorotic mottle virus. Additional suitable viruses include Rice Necrosis virus (RNV), and geminiviruses such as tomato golden mosaic virus (TGMV), Cassaya latent virus (CLV) and maize streak virus (MSV). However, the invention should not be construed as limited to using these particular viruses, but rather the method of the present invention is contemplated to include all plant viruses at a minimum.

Other embodiments of plant vectors used for the expression of sequences encoding polypeptides include, for example, viral promoters such as the 35S and 19S promoters of CaMV used alone or in combination with the omega leader sequence from TMV (Takamatsu, EMBO J. 6:307 [1987]). Alternatively, plant promoters such as the small subunit of RUBISCO or heat shock promoters may be used (Coruzzi et al., EMBO J. 3:1671 [1984]; Broglie et al., Science 224:838 [1984]; and Winter et al., Results Probl. Cell Differ. 17:85 [1991]). These constructs can be introduced into plant cells by direct DNA transformation or pathogen-mediated transfection. Such techniques are described in a number of generally available reviews (See for example, Hobbs, S. or Murry, L. E. in McGraw Hill Yearbook of Science and Technology (1992) McGraw Hill, New York, N.Y.; pp. 191-196.

An insect system may also be used to express polypeptides (for example, a polypeptide encoded by a nucleic acid of the present invention). For example, in one such system, *Autographa californica* nuclear polyhedrosis virus (AcNPV) is used as a vector to express foreign genes in *Spodoptera frugiperda* cells or in *Trichoplusia larvae*. The sequences encoding a polypeptide of interest may be cloned into a non-essential region of the virus, such as the polyhedrin gene, and placed under control of the polyhedrin promoter. Successful insertion of the nucleic acid sequence encoding the polypeptide of interest will render the polyhedrin gene inactive and produce recombinant virus lacking coat protein. The recombinant viruses may then be used to infect, for example, *S. frugiperda* cells or *Trichoplusia larvae* in which the polypeptide may be expressed (Engelhard et al., Proc. Nat. Acad. Sci. 91:3224 [1994]).

In mammalian host cells, a number of viral-based expression systems may be utilized. In cases where an adenovirus is used as an expression vector, sequences encoding polypeptides may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan and Shenk, Proc. Natl. Acad. Sci., 81:3655 [1984]). In addition, transcription enhancers, such as the Rous sarcoma virus (RSV) enhancer, may be used to increase expression in mammalian host cells.

Specific initiation signals may also be used to achieve more efficient translation of sequences encoding the polypeptide of interest. Such signals include the ATG initiation codon and adjacent sequences. In cases where sequences encoding the polypeptide of interest, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf et al., Results Probl. Cell Differ., 20:125 [1994]).

In addition, a host cell strain may be chosen for its ability to modulate the expression of the inserted sequences or to process the expressed protein in the desired fashion. Such modifications of the polypeptide include, but are not limited to, acetylation, carboxylation, glycosylation, phosphorylation, lipidation, and acylation. Post-translational processing which cleaves a "prepro" form of the protein may also be used to facilitate correct insertion, folding and/or function. Different host cells such as CHO, HeLa, MDCK, HEK293, and WI38, which have specific cellular machinery and characteristic mechanisms for such post-translational activities, may be chosen to ensure the correct modification and processing of the foreign protein.

For long-term, high-yield production of recombinant proteins, stable expression is preferred. For example, cell lines which stably express the polypeptide of interest (for example, a polypeptide encoded by a nucleic acid of the present invention) may be transformed using expression vectors which may contain viral origins of replication and/or endogenous expression elements and a selectable marker gene on the same or on a separate vector. Following the introduction of the vector, cells may be allowed to grow for 1-2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler et al., Cell 11:223 [1977]) and adenine phosphoribosyltransferase (Lowy et al., Cell 22:817 [1980]) genes which can be employed in tk⁻ or aprt⁻ cells, respectively. Also, antimetabolite, antibiotic, or herbicide resistance can be used as the basis for selection; for example, dhfr, which confers resistance to methotrexate (Wigler et al., Proc. Natl. Acad. Sci., 77:3567 [1980]); npt, which confers resistance to the aminoglycosides neomycin and G-418 (Colbere-Garapin et al., J. Mol. Biol., 150:1 [1981]); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman. and Mulligan, Proc. Natl. Acad. Sci., 85:8047 [1988]). Recently, the use of visible markers has gained popularity with such markers as anthocyanins, α-glucuronidase and its substrate GUS, and luciferase and its substrate luciferin, being widely used not only to identify transformants, but also to quantify the amount of transient or stable protein expression attributable to a specific vector system (Rhodes et al., Methods Mol. Biol., 55:121 [1995]).

Although the presence/absence of marker gene expression suggests that the gene of interest is also present, its presence and expression may need to be confirmed. For example, if the sequence encoding a polypeptide is inserted within a marker gene sequence, recombinant cells containing sequences encoding the polypeptide can be identified by the absence of marker gene function. Alternatively, a marker gene can be placed in tandem with a sequence encoding the polypeptide under the control of a single promoter. Expression of the marker gene in response to induction or selection usually indicates expression of the tandem gene as well.

Alternatively, host cells which contain the nucleic acid sequence encoding the polypeptide of interest (for example, a polypeptide encoded by a nucleic acid of the present invention) and express the polypeptide may be identified by a variety of procedures known to those of skill in the art. These procedures include, but are not limited to, DNA-DNA or DNA-RNA hybridizations and protein bioassay or immunoassay techniques which include membrane, solution, or chip based technologies for the detection and/or quantification of nucleic acid or protein.

The presence of polynucleotide sequences encoding a polypeptide of interest (for example, a polypeptide encoded by a nucleic acid of the present invention) can be detected by DNA-DNA or DNA-RNA hybridization or amplification using probes or portions or fragments of polynucleotides encoding the polypeptide. Nucleic acid amplification based assays involve the use of oligonucleotides or oligomers based on the sequences encoding the polypeptide to detect transformants containing DNA or RNA encoding the polypeptide. As used herein "oligonucleotides" or "oligomers" refer to a nucleic acid sequence of at least about 10 nucleotides and as many as about 60 nucleotides, preferably about 15 to 30 nucleotides, and more preferably about 20-25 nucleotides, which can be used as a probe or amplimer.

A variety of protocols for detecting and measuring the expression of a polypeptide (for example, a polypeptide encoded by a nucleic acid of the present invention), using either polyclonal or monoclonal antibodies specific for the protein are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on the polypeptide is preferred, but a competitive binding assay may be employed. These and other assays are described, among other places, in Hampton et al., 1990; Serological Methods, a Laboratory Manual, APS Press, St Paul, Minn. and Maddox et al., J. Exp. Med., 158:1211 [1983]).

A wide variety of labels and conjugation techniques are known by those skilled in the art and may be used in various nucleic acid and amino acid assays. Means for producing labeled hybridization or PCR probes for detecting sequences related to polynucleotides encoding a polypeptide of interest include oligonucleotide labeling, nick translation, end-labeling or PCR amplification using a labeled nucleotide. Alternatively, the sequences encoding the polypeptide, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits from Pharmacia & Upjohn (Kalamazoo, Mich.), Promega Corporation (Madison, Wis.) and U.S. Biochemical Corp. (Cleveland, Ohio). Suitable reporter molecules or labels, which may be used, include radionuclides, enzymes, fluorescent, chemiluminescent, or chromogenic agents as well as substrates, cofactors, inhibitors, magnetic particles, and the like.

Host cells transformed with nucleotide sequences encoding a polypeptide of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides which encode the polypeptide of interest (for example, a polypeptide encoded by a nucleic acid of the present invention) may be designed to contain signal sequences which direct secretion of the polypeptide through a prokaryotic or eukaryotic cell membrane. Other recombinant constructions may be used to join sequences encoding the polypeptide to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domaim utilized in the FLAGS extension/affinity purification system (Immunex Corp., Seattle, Wash.). The inclusion of cleavable linker sequences such as those specific for Factor XA or enterokinase (available from Invitrogen, San Diego, Calif.) between the purification domain and the polypeptide of interest may be used to facilitate purification. One such expression vector provides for expression of a fusion protein containing the polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath et al., Prot. Exp. Purif., 3:263 [1992] while the enterokinase cleavage site provides a means for purifying the polypeptide from the fusion protein. A discussion of vectors which contain fusion proteins is provided in Kroll et al., DNA Cell Biol., 12:441 [1993]).

In addition to recombinant production, fragments of the polypeptide of interest may be produced by direct peptide synthesis using solid-phase techniques (Merrifield, J. Am. Chem. Soc., 85:2149 [1963]). Protein synthesis may be performed using manual techniques or by automation. Automated synthesis may be achieved, for example, using the Applied Biosystems 431A peptide synthesizer (Perkin Elmer). Various fragments of the polypeptide may be chemically synthesized separately and combined using chemical methods to produce the full length molecule.

V. Altering of Gene Expression

It is contemplated that the polynucleotides of the present invention (for example, SEQ ID NOs:1-571) may be utilized to either increase or decrease the level of corresponding mRNA and/or protein in transfected cells as compared to the levels in wild-type cells. Accordingly, in some embodiments, expression in plants by the methods described above leads to the overexpression of the polypeptide of interest in transgenic plants, plant tissues, or plant cells. The present invention is not limited to any particular mechanism. Indeed, an understanding of a mechanism is not required to practice the present invention. However, it is contemplated that overexpression of the polynucleotides of the present invention will alter the expression of the gene comprising the nucleic acid sequence of the present invention.

In other embodiments of the present invention, the polynucleotides are utilized to decrease the level of the protein or mRNA of interest in transgenic plants, plant tissues, or plant cells as compared to wild-type plants, plant tissues, or plant cells. One method of reducing protein expression utilizes expression of antisense transcripts (for example, U.S. Pat. Nos. 6,031,154; 5,453,566; 5,451,514; 5,859,342; and 4,801,340). Antisense RNA has been used to inhibit plant target genes in a tissue-specific manner (for example, Van der Krol et al., Biotechniques 6:958-976 [1988]). Antisense inhibition has been shown using the entire cDNA sequence as well as a partial cDNA sequence (for example, Sheehy et al., Proc. Natl. Acad. Sci. USA 85:8805-8809 [1988]; Cannon et al., Plant Mol. Biol. 15:39-47 [1990]). There is also evidence that 3' non-coding sequence fragment and 5' coding sequence fragments, containing as few as 41 base-pairs of a 1.87 kb cDNA, can play important roles in antisense inhibition (Ch'ng et al., Proc. Natl. Acad. Sci. USA 86:10006-10010 [1989]).

Accordingly, in some embodiments, the nucleic acids of the present invention (for example, SEQ ID NOs: 1-571, and fragments and variants thereof) are oriented in a vector and expressed so as to produce antisense transcripts. To accomplish this, a nucleic acid segment from the desired gene is cloned and operably linked to a promoter such that the antisense strand of RNA will be transcribed. The expression cassette is then transformed into plants and the antisense strand of RNA is produced. The nucleic acid segment to be introduced generally will be substantially identical to at least a portion of the endogenous gene or genes to be repressed. The sequence, however, need not be perfectly identical to inhibit expression. The vectors of the present invention can be designed such that the inhibitory effect applies to other proteins within a family of genes exhibiting homology or substantial homology to the target gene.

Furthermore, for antisense suppression, the introduced sequence also need not be full length relative to either the primary transcription product or fully processed mRNA. Generally, higher homology can be used to compensate for the use of a shorter sequence. Furthermore, the introduced sequence need not have the same intron or exon pattern, and homology of non-coding segments may be equally effective. Normally, a sequence of between about 30 or 40 nucleotides and up to about the full length full length of the coding region should be used, although a sequence of at least about 100 nucleotides is preferred, a sequence of at least about 200 nucleotides is more preferred, and a sequence of at least about 500 nucleotides is especially preferred.

Catalytic RNA molecules or ribozymes can also be used to inhibit expression of the target gene or genes. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA-cleaving activity upon them, thereby increasing the activity of the constructs.

A number of classes of ribozymes have been identified. One class of ribozymes is derived from a number of small circular RNAs which are capable of self-cleavage and replication in plants. The RNAs replicate either alone (viroid RNAs) or with a helper virus (satellite RNAs). Examples include RNAs from avocado sunblotch viroid and the satellite RNAs from tobacco ringspot virus, lucerne transient streak virus, velvet tobacco mottle virus, Solanum nodiflorum mottle virus and subterranean clover mottle virus. The design and use of target RNA-specific ribozymes is described in Haseloff, et al., Nature 334:585-591 (1988).

Another method of reducing protein expression utilizes the phenomenon of cosuppression or gene silencing (for example, U.S. Pat. Nos. 6,063,947; 5,686,649; and 5,283, 184). The phenomenon of cosuppression has also been used to inhibit plant target genes in a tissue-specific manner. Cosuppression of an endogenous gene using a full-length cDNA sequence as well as a partial cDNA sequence (730 bp of a 1770 bp cDNA) are known (for example, Napoli et al., Plant Cell 2:279-289 [1990]; van der Krol et al., Plant Cell 2:291-299 [1990]; Smith et al., Mol. Gen. Genetics 224: 477-481 [1990]). Accordingly, in some embodiments the nucleic acids (for example, SEQ ID NOs: 1-571, and fragments and variants thereof) from one species of plant are expressed in another species of plant to effect cosuppression of a homologous gene. Generally, where inhibition of expression is desired, some transcription of the introduced sequence occurs. The effect may occur where the introduced sequence contains no coding sequence per se, but only mtron or untranslated sequences homologous to sequences present in the primary transcript of the endogenous sequence. The introduced sequence generally will be substantially identical to the endogenous sequence intended to be repressed. This minimal identity will typically be greater than about 65%, but a higher identity might exert a more effective repression of expression of the endogenous sequences. Substantially greater identity of more than about 80% is preferred, though about 95% to absolute identity would be most preferred. As with antisense regulation, the effect should apply to any other proteins within a similar family of genes exhibiting homology or substantial homology.

For cosuppression, the introduced sequence in the expression cassette, needing less than absolute identity, also need not be full length, relative to either the primary transcription product or fully processed mRNA. This may be preferred to avoid concurrent production of some plants which are overexpressers. A higher identity in a shorter than full length sequence compensates for a longer, less identical sequence. Furthermore, the introduced sequence need not have the same intron or exon pattern, and identity of non-coding segments will be equally effective. Normally, a sequence of the size ranges noted above for antisense regulation is used.

VI. Expression of Sequences Producing Stunting Phenotype

The present invention provides nucleic sequences involved in stunting of growth in plants. Plants transformed with viral vectors comprising the nucleic acid sequences of the present invention were screened for a stunting phenotype (see Examples 10 and 18). Accordingly, in some embodiments, the present invention provides nucleic acid sequences that produce a stunting phenotype when expressed in plant. The present invention is not limited to the particular nucleic acid sequences listed. Indeed, it contemplated that nucleic acid sequences which hybridize to the listed nucleic sequences under conditions ranging from low to high stringency and which also cause the stunting phenotype. These sequences are conveniently identified by insertion into GENEWARE vectors and expression in plants as detailed in the examples. Accordingly, in particularly preferred embodiments, the sequences that produce a stunting phenotype, include, but are not limited to, SEQ ID NOs: 47, 58, 336, 288, 291, 297, 302, 304, 313, 321, 322, 323, 324, 325, 326, 327, 328, 329, 330, 331, 332 and sequences that hybridize to these sequences under conditions of low to high stringency. In some embodiments, the sequences are operably linked to a plant promoter or provided in a vector as described in more detail above. Furthermore, the sequences can be expressed in either sense or antisense orientation. In particularly preferred embodiments, the sequences are at least 30 nucleotides in length up to the length of the full-length of the corresponding gene. It is contemplated that sequences of less than full length (for example, greater than about 30 nucleotides) are useful for down regulation of gene expression via antisense or cosuppression. Suitable sequences are selected by chemically synthesizing the sequences, cloning into GENEWARE expression vectors, expressing in plants, and selecting plants with a stunting phenotype.

VII. Characterization of Metabolic Hits

In some embodiments, the present invention provides novel methods for the characterization of the chemical nature of genetic modifications made in tobacco plants using GENEWARE viral vector technology or other expression technologies. The methods comprise separating fractions from leaf extracts of plants transfected with nucleic acid sequences of the present invention using chromatographic and mass spectroscopy techniques, followed by searching a series of databases.

In some embodiments, the characterization is performed on samples identified as metabolic hits (as described above and in Example 19). In some embodiments, samples are labeled with a bar code to facilitate tracking and database searching. Samples are first separated using chromatography (for example, gas chromatography (GC)), followed by mass spectroscopy (MS). The present invention is not limited to a particular GC/MS system. Any suitable analysis system may be utilized, including but not limited to, those commercially available from Agilent Technologies, Hewllet Packard, Leap Technologies, and APEX.

In preferred embodiments, internal standards are added to the samples prior to analysis. The internal standards utilized are specific to the leaf Fraction analyzed. For example, in some embodiments, fraction 1 (See Example 19 for a description of component of fractions) is analyzed using the internal standards Pentacosane and Hexatriacontane, Fraction 2 is analyzed using Undecanoic acid, methyl ester and Tetracosanoic acid, methyl ester as internal standards, and Fraction 3 is analyzed using n-Octyl-β-D-Glucopyranoside.

In some embodiments, certain fractions (for example, those containing lipids or highly polar water-soluble molecules) are derivatized prior to analysis to make certain components more amenable to gas chromatography. The present invention is not limited to the analysis of the fractions described herein. Any separated solution containing biological macromolecules (for example, proteins, lipid, and carbohydrates) may be analyzed using the methods of the present invention. GC/MS may be performed using any suitable protocol, including but not limited to, those described in Example 20 below. In preferred embodiments, instrument performance standards are analyzed alone with fractionated sample (see Example 20 for examples of suitable standards).

In some embodiments, sample and Reference data sets are next processed using the Bioinformatics computer program Maxwell (The Dow Chemical Company, Midland, Mich.). The principal elements of the program are 1) Data Reduction, 2) two-dimensional Peak Matching, 3) Quantitative Peak Differentiation (Determination of Relative Quantitative Change), 4) Peak Identification, 5) Data Sorting, and 6) Customized Reporting.

The program first queries the user for the filenames of the Reference data set and Sample data set(s) to compare against the Reference. The program then integrates the Total Ion Chromatogram (TIC) of the data sets using (for example, using Agilent Technologies HP ChemStation integrator parameters). In preferred embodiments, parameters for integration are determined by the analyst. The corresponding raw peak areas are then normalized to the respective Internal Standard peak area. Peak tables from the Reference and each Sample are then generated. The peak tables are comprised of retention time (RT), retention index (RI)—the retention time relative to the Internal Standard RT, raw peak areas, peak areas normalized to the Internal Standard, and other pertinent information.

In preferred embodiments, following peak identification, one or more (preferably two) filtering steps are employed. In some embodiments, filtering criteria are established by the analyst and must be met before a peak is further analyzed. In some embodiments, the first filtering criterion is based upon a peak-'s normalized area. All normalized peaks having values below the Limit of Processing for Peak Matching (LOP-PM), are considered to be "background." In preferred embodiments, background peaks are not carried forward for any type of mathematical calculation or spectral comparison.

In some embodiments, an initial peak-matching step, comprising comparing the Sample peak table to the Reference peak table pairing peaks based upon their respective RI values matching one another (within a given variable window) is conducted. In some embodiments, the next step in the peak matching routine comprises a spectral comparison of Sample and Reference peaks that have been chromatographically. The spectral matching is performed using a mass spectral cross-correlation algorithm within the Agilent Technologies HP ChemStation software. The cross-correlation algorithm generates an equivalence value based upon spectral "fit" that is used to determine whether the chromatographically matched peaks are spectrally similar or not. This equivalence value is referred to as the MS-XCR value and must meet or exceed a predetermined value for a pair of peaks to be "MATCHED," which means they appear to be the same compound in both the Reference and the Sample. The MS-XCR value can also be used to judge peak purity.

In preferred embodiments, the two-dimensional peak matching process is repeated until all potential peak matches were processed. At the end of the process, peaks are categorized into two categories, MATCHED and UNMATCHED.

In some embodiments, a second filtering criterion is next invoked. The second filtering step is also based upon the normalized area of the MATCHED or UNMATCHED peak. For a peak to be reported and further processed, its normalized area must meet or exceed the predetermined Limit of Processing for Sorting (LOP-SRT).

Peaks that are UNMATCHED are immediately flagged as different. UNMATCHED peaks are of two types. There are those that are reported in the Reference but appear to be absent in the Sample (based upon criteria for quantitation and reporting). These peaks are designated in with a percent change of "—100 percent" and the description "UNMATCHED IN SAMPLE." The second types of peaks are those that are not reported in the Reference (again, based upon criteria for quantitation and reporting) but were reported in the Sample, thus appearing to be "new" peaks. These peaks are designated with a percent change of "100 percent" and the description "NEW PEAK UNMATCHED IN NULL."

In preferred embodiments, MATCHED peaks are processed further for relative quantitative differentiation. This quantitative differentiation is expressed as a percent change of the Sample peak area relative to the area of the Reference peak. A predetermined threshold for change must be observed for the change to be determined biochemical and statistically significant. The change threshold is based upon previously observed biological and analytical variability factors. Only changes above the threshold for change are reported.

In some embodiments, following filtration, peaks are next processed through a peak identification process. In some embodiments, the mass spectra of the peaks is first searched against a mass spectral plant metabolite libraries (for example, including but not limited to, the database developed by Function Discovery Laboratories, The Dow Chemical Company, Midland, Mich.). The equivalence value assigned to the library match is used as an indication of a proper identification. In some embodiments, in order to provide additional confirmation to the identity of a peak, or to suggest other possibilities, library hits are searched further against a Biotechnology database (for example, including but not limited to, the database developed by Function Discovery Laboratories, The Dow Chemical Company, Midland, Mich.). In preferred embodiments, the Biotechnology database incorporates chemical structures.

In some embodiments, the Chemical Abstract Services (CAS) number of compounds identified from the library is searched against those contained in the database. If a match is found, the CAS number in the database is then correlated to the data acquisition method for that record. If the method matches, the program then compares the retention index (RI) of the component against the value contained in the database for that given method. Should the RI's match (within a given window of variability), then the peak identity is given a high degree of certainty. In some embodiments, components in the Sample that are not identified by this process are assigned a unique identifier for tracking.

In preferred embodiments, the program then sorts the data to generate a preliminary report referred to as an analyst report. The analyst report includes, but it not limited to, PBM algorithm match quality value (equivalence value), RT, Normalized Peak Area, RI (Sample), RI (database) Peak Identification status [peak identity of high certainty (peaks identified by the program based on the pre-established criteria) or criteria not met (program did not positively identify the component)], Component Name, CAS Number, Mass Spectral Library (containing spectrum most closely matched to that of the component), Unknown ID (unique identifier used to track unidentified components), MS-XCR value, Relative % Change, Notes (MATCHED/UNMATCHED), and other miscellaneous information. In some embodiments, the analyst report is reviewed by an analyst, who edits the report to generate a modified report for further processing by the program.

For compounds that were derivitized prior to analysis, the compound names in the modified analyst report (MAR) are those of the derivatives. In some embodiments, to accurately reflect the true components of these fractions, the MAR is further processed using information contained in an additional database that cross-references the observed derivatized compound to that of the original, underivatized "parent" compound by way of their respective CAS numbers and replaces derivatives with parent names and information for the final report. In addition, any unidentified components are assigned a "999999-99-9" CAS number for the final report. In some embodiments, the Modified Analyst Report also contains a HIT Score of 0, 1, or 2. The value is assigned by the analyst to the data set of the Sample aliquot based on criteria, including but not limited to, 0=No FDL data on Sample; 1=FDL data collected; Sample not FDL HIT; and 2=FDL data collected; Sample is FDL HIT. An FDL HIT is defined as a reportable percent change (modification) observed in a Sample relative to Reference in a component of biochemical significance.

In some embodiments, an electronic copy of the final report is entered into the Nautilus LIMS system (BLIMS) and subsequently into eBRAD (Biotech database). In some embodiments, the program generates a hardcopy of the pinpointed TIC and the respective mass spectrum of each component that was reported to have changed.

VIII. Sequences Identified from Metabolic Screens

In some embodiments, the present invention provides nucleic sequences that alter the metabolism of plants when expressed in plants. Plants transformed with viral vectors comprising the nucleic acid sequences of the present invention were screened for an altered metabolism phenotype (see Examples 19 and 20). A number of such sequences were identified. Accordingly, in some embodiments, the present invention provides nucleic acid sequences that produce an altered metabolism phenotype when expressed in plant. The present invention is not limited to the particular nucleic acid sequences listed. Indeed, it contemplated that nucleic acid sequences which hybridize to the listed nucleic sequences under conditions ranging from low to high stringency and which also cause the stunting phenotype. These sequences are conveniently identified by insertion into GENEWARE vectors and expression in plants as detailed in the examples. Accordingly, in particularly preferred embodiments, the sequences that produce an altered metabolism phenotype, include, but are not limited to, SEQ ID NOs: 281-304, 306-312, 314-324, 326-330 and 333339-343 and sequences that hybridize to these sequences under conditions of low to high stringency. In some embodiments, the sequences are operably linked to a plant promoter or provided in a vector as described in more detail above. These present invention also contemplates plants transformed or transfected with these sequences as well as seeds from such transfected plants. Furthermore, the sequences can expressed in either sense or antisense orientation. In particularly preferred embodiments, the sequences are at least 30 nucleotides in length up to the length of the full-length of the corresponding gene. It is contemplated that sequences of less than full length (for example, greater than about 30 nucleotides) are useful for down regulation of gene expression via antisense or cosupression. Suitable sequences are selected by chemically synthesizing the sequences, cloning into GENEWARE expression vectors, expressing in plants, and selecting plants with an altered metabolism phenotype.

In some embodiments, the present invention provides methods and compositions for increasing, decreasing, or otherwise altering the production of acids in plants. Examples of acids that can be altered according to the present invention include, but are not limited to, citric acid, carbamic acid, glyceric acid, phosphoric acid, 11-eicosenoic acid (11Z), caffeic acid, chlorogenic acid, malic acid, phosphoric acid, inositol, terephthalic acid. The alterations in metabolic profile are preferably accomplished by expressing one or more of the following nucleic acid sequences (or sequences that hybridize thereto) in a plant: SEQ ID NO:335 (170074), SEQ ID NO:336 (175736), SEQ ID NO:282 (23242), SEQ ID NO:283 (23869), SEQ ID NO:289 (25026), SEQ ID NO:292 (25118), SEQ ID NO:293 (25124), SEQ ID NO:296 (25164), SEQ ID NO:297 (25170), SEQ ID NO:298 (25176), SEQ ID NO:299 (25196), SEQ ID NO:306 (27430), SEQ ID NO:311 (27819), SEQ ID NO:315 (30913), SEQ ID NO:318 (37186), SEQ ID NO:321 (45801), SEQ ID NO:323 (45808), SEQ ID NO:324 (45820), SEQ ID NO:328 (45855), and SEQ ID NO:329 (45864). In preferred embodiments, expression in plants of the sequences that hybridize to the preceding sequences also results in an increase, decrease, or alteration of acid production in a plant.

In some embodiments, the present invention provides methods and compositions for increasing, decreasing, or otherwise altering the production of fatty acids in plants. Examples of fatty acids that can be altered according to the present invention include, but are not limited to, 9-octadecadienoic acid (9Z), eicosanoic acid, hexadecanoic acid, octadecanoic acid, 9,12,15-octadecatrienoic acid, 9,12-octadecadienoic acid, 7,10,13-docosatrionic acid (7Z,10Z,13Z), 7,10,13-hexadecatrienoic acid, docosanoic acid, heptadecanoic acid, 9-hexadecenoic acid, tetradecanoic acid, and 9-octadecenoic acid. The alterations in metabolic profile are preferably accomplished by expressing one or more of the following nucleic acid sequences (or sequences that hybridize thereto) in a plant: 175736 (SEQ ID NO:336), 21604 (SEQ ID NO:281), 23242 (SEQ ID NO:282), 23869 (SEQ ID NO:283), 25009 (SEQ ID NO:286), 25011 (SEQ ID NO:287), 25015 (SEQ ID NO:288), 25062 (SEQ ID NO:290), 25104 (SEQ ID NO:291), 25133 (SEQ ID NO:294), 25144 (SEQ ID NO:295), 25170 (SEQ ID NO:297), 25176 (SEQ ID NO:298), 25196 (SEQ ID NO:299), 25421 (SEQ ID NO:300), 25431 (SEQ ID NO:302), 27440 (SEQ ID NO:307), 27460 (SEQ ID NO:309), 27468 (SEQ ID NO:310), 27819 (SEQ ID NO:311), 30307 (SEQ ID NO:314), 30913 (SEQ ID NO:315), 34136 (316), 37186 (SEQ ID NO:318), 37188 (SEQ ID NO:319), 45801 (321), 45804 (SEQ ID NO:322), 45864 (SEQ ID NO:329) and 56465 (SEQ ID NO:333). In preferred embodiments, expression in plants of the sequences that hybridize to the preceding sequences also results in an increase, decrease, or alteration of fatty acid production in a plant.

In some embodiments, the present invention provides methods and compositions for increasing, decreasing, or otherwise altering the production of branched fatty acids in plants. Examples of branched fatty acids that can be altered according to the present invention include, but are not limited to, 16-methyl-heptadecanoic acid, 16-methyl-heptadecanoic acid, and 14-methyl-hexadecanoic acid. The alterations in metabolic profile are preferably accomplished by expressing one or more of the following nucleic acid sequences (or sequences that hybridize thereto) in a plant: 175736 (SEQ ID NO:336), 23242 (SEQ ID NO:282), 23869 (SEQ ID NO:283), 25009 (SEQ ID NO:286), 25015 (SEQ ID NO:288), 25062 (SEQ ID NO:290), 25104 (SEQ ID NO:291), 25133 (SEQ ID NO:294), 25144 (SEQ ID NO:295), 25170 (SEQ ID NO:297), 25196 (SEQ ID NO:299), 25431 (SEQ ID NO:302), 27440 (SEQ ID NO:307), 27460 (SEQ ID NO:309), 27468 SEQ ID NO:310), 30307 (SEQ iD NO:314), 30913 (SEQ ID NO:315), 37188 (SEQ ID NO:319), and 45801 (SEQ IID NO:321). In preferred embodiments, expression in plants of the sequences that hybridize to the preceding sequences also results in an increase, decrease, or alteration of branched fatty acid production in a plant.

In some embodiments, the present invention provides methods and compositions for increasing, decreasing, or otherwise altering the production of hydroxy fatty acids in plants. Examples of hydroxy fatty acids that can be altered according to the present invention include, but are not limited to, malic acid, 2,3,4-trihydroxy-butanoic acid, 3,4-dihydroxy-butanoic acid, 2,3-dihydroxypropyl-9,12-octadecadienoic acid ester, and 2,3-bis(acetyyloxy)propyl-eicosanoic acid ester. The alterations in metabolic profile are preferably accomplished by expressing one or more of the following nucleic acid sequences (or sequences that hybridize thereto) in a plant: 105039 (SEQ ID NO:334), 23242 (SEQ ID NO:282), 23869 (SEQ ID NO:283), 25026 (SEQ ID NO:289), 27430 (SEQ ID NO:306), 27819 (SEQ ID NO:311), 30913 (SEQ ID NO:315), 37188 (SEQ ID NO:319), and 45808 (SEQ ID NO:323). In preferred embodiments, expression in plants of the sequences that hybridize to the preceding sequences also results in an increase, decrease, or alteration of hydroxy fatty acid production in a plant.

In some embodiments, the present invention provides methods and compositions for increasing, decreasing, or otherwise altering the production of alcohols in plants. Examples of alcohols that can be altered according to the present invention include, but are not limited to, inositol. The alterations in metabolic profile are preferably accomplished by expressing one or more of the following nucleic acid sequences (or sequences that hybridize thereto) in a plant: 25124 (SEQ ID NO:293), 25170 (SEQ ID NO:297), 25176 (SEQ ID NO:298), 25118 (SEQ ID NO:299), 37186 (SEQ ID NO:318), 37188 (SEQ ID NO:319), 45801 (SEQ ID NO:321), 45808 (SEQ ID NO:323), 45820 (SEQ ID NO:324), 45855 (SEQ ID NO:328), and 45864 (SEQ ID NO:329). In preferred embodiments, expression in plants of the sequences that hybridize to the preceding sequences also results in an increase, decrease, or alteration of alcohol production in a plant.

In some embodiments, the present invention provides methods and compositions for increasing, decreasing, or otherwise altering the production of alkaloids and other bases in plants. Examples of alkaloids and other bases that can be altered according to the present invention include, but are not limited to, 1,4-butanediamine. The alterations in metabolic profile are preferably accomplished by expressing one or more of the following nucleic acid sequences (or sequences that hybridize thereto) in a plant: 25124 (SEQ ID NO:293), 25164 (SEQ ID NO:296), 25170 (SEQ ID NO:297), 27819 (SEQ ID NO:311), and 37186 (SEQ ID NO:318). In preferred embodiments, expression in plants of the sequences that hybridize to the preceding sequences also results in an increase, decrease, or alteration of alkaloid and other base production in a plant.

In some embodiments, the present invention provides methods and compositions for increasing, decreasing, or otherwise altering the production of alkenes and alkynes in plants. Examples of alkenes and alkynes that can be altered according to the present invention include, but are not limited to, squalene and limonene. The alterations in metabolic profile are preferably accomplished by expressing one or more of the following nucleic acid sequences (or sequences that hybridize thereto) in a plant: 23242 (SEQ ID NO:282), 25124 (SEQ ID NO:293), and 25196 (SEQ ID NO:299). In preferred embodiments, expression in plants of the sequences that hybridize to the preceding sequences also results in an increase, decrease, or alteration of alkene and alkyne production in a plant.

In some embodiments, the present invention provides methods and compositions for increasing, decreasing, or otherwise altering the production of amino acids and related compounds in plants. Examples of amino acids and related compounds that can be altered according to the present invention include, but are not limited to, histidine, leucine, methionine, proline, glycine, alanine, serine, aspartic acid, glutamic acid, lysine, cysteine, tyrosine, phenylalanine, histidine, valine, threonine, arginine, proline, glutamine, tryptophan, isoleucine, 5-oxo-proline. The alterations in metabolic profile are preferably accomplished by expressing one or more of the following nucleic acid sequences (or sequences that hybridize thereto) in a plant: 105039 (SEQ ID NO:334), 182206 (SEQ ID NO:280), 170074 (SEQ ID NO:335), 175736 (SEQ ID NO:336), 21604 (SEQ ID NO:281), 23242 (SEQ ID NO:282), 23869 (SEQ ID NO:283), 25004 (SEQ ID NO:284), 25008 (SEQ ID NO:285), 25015 (SEQ ID NO:288), 25026 (SEQ ID NO:289), 25057 (SEQ ID NO:338), 25080 (SEQ ID NO:337), 25124 (SEQ ID NO:293), 25164 (SEQ ID NO:296), 25170 (SEQ ID NO:297), 25176 (SEQ ID NO:298), 25196 (SEQ]ID NO:299), 25425 (SEQ ID NO:301), 25431 (SEQ ID NO:302), 27410 (SEQ ID NO:303), 27424 (SEQ ID NO:304), 27459 (SEQ ID NO:308), 27460 (SEQ ID NO:309), 27468 (SEQ ID NO:310), 27819 (SEQ ID NO:311), 30913 (SEQ ID NO:315), 34442 (SEQ ID NO:317), 37186 (SEQ ID NO:318), 37188 (SEQ ID NO:319), 38919 (SEQ ID NO:320), 45801 (SEQ ID NO:321), 45808 (SEQ ID NO:323), 45820 (SEQ ID NO:324), 45850 (SEQ ID NO:326), 45853 (SEQ ID NO:327), 45855 (SEQ ID NO:328), 45864 (SEQ ID NO:329), and 45866 (SEQ ID NO:330). In preferred embodiments, expression in plants of the sequences that hybridize to the preceding sequences also results in an increase, decrease, or alteration of amino acid and related compounds production in a plant.

In some embodiments, the present invention provides methods and compositions for increasing, decreasing, or otherwise altering the production of carbohydrates in plants. Examples of carbohydrates that can be altered according to the present invention include, but are not limited to, hexose, glucose, fructose, sucrose, galactose, and xylose. The alterations in metabolic profile are preferably accomplished by expressing one or more of the following nucleic acid sequences (or sequences that hybridize thereto) in a plant: 105039 (SEQ ID NO:334), 170074 (SEQ ID NO:335), 23242 (SEQ ID NO:282), 23869 (SEQ ID NO:283), 25026 (SEQ ID NO:289), 25124 (SEQ ID NO:293), 25164 (SEQ ID NO:296), 25170 (SEQ ID NO:297), 25196 (SEQ ID NO:299), 27430 (SEQ ID NO:306), 27819 (SEQ ID NO:311), 27864 (SEQ ID NO:312), 30913 (SEQ ID NO:315), 37186 (SEQ ID NO:318), 37188 (SEQ ID NO:319), 45801 (SEQ ID NO:321), 45808 (SEQ ID NO:323), 45820 (SEQ ID NO:324), 45855 (SEQ ID NO:328), and 45864 (SEQ ID NO:329). In preferred embodiments, expression of the sequences that hybridize to the preceding sequences also results in an increase, decrease, or alteration of carbohydrate production in a plant.

In some embodiments, the present invention provides methods and compositions for increasing, decreasing, or otherwise altering the production of esters in plants. Examples of esters that can be altered according to the present invention include, but are not limited to, 2-methyl-, 3-hydroxy-2,4,4-trimethylpentyl-propanoic acid ester. The alterations in metabolic profile are preferably accomplished by expressing one or more of the following nucleic acid sequences (or sequences that hybridize thereto) in a plant: 23869 (SEQ ID NO:283). In preferred embodiments, expression in plants of the sequences that hybridize to the preceding sequences also results in an increase, decrease, or alteration of ester production in a plant.

In some embodiments, the present invention provides methods and compositions for increasing, decreasing, or otherwise altering the production of glycerides in plants. Examples of glycerides that can be altered according to the present invention include, but are not limited to, 9,12-octadecadienoic acid (9Z,12Z)-2,3-dihydroxypropyl ester, glycerol palmitate, and glycerol phosphate. The alterations in metabolic profile are preferably accomplished by expressing one or more of the following nucleic acid sequences (or sequences that hybridize thereto) in a plant: 21604 (SEQ ID NO:281), 23242 (SEQ ID NO:282), 27819 (SEQ ID NO:311), 30913 (SEQ ID NO:315), 45808 (SEQ ID NO:323) and 56465 (SEQ ID NO:333). In preferred embodiments, expression in plants of the sequences that hybridize to the preceding sequences also results in an increase, decrease, or alteration of glyceride production in a plant.

In some embodiments, the present invention provides methods and compositions for increasing, decreasing, or otherwise altering the production of hydrocarbons in plants. Examples of hydrocarbons that can be altered according to the present invention include, but are not limited to, 2-methyl-triacontane and squalene. The alterations in metabolic profile are preferably accomplished by expressing one or more of the following nucleic acid sequences (or sequences that hybridize thereto) in a plant: 23242 (SEQ ID NO:282), 25196 (SEQ ID NO:299), 27410 (SEQ ID NO:303), 37188 (SEQ ID NO:319), 38919 (SEQ ID NO:320), 45808 (SEQ ID NO:323) and 56465 (SEQ ID NO:333). In preferred embodiments, expression in plants of the sequences that hybridize to the preceding sequences also results in an increase, decrease, or alteration of hydrocarbon production in a plant.

In some embodiments, the present invention provides methods and compositions for increasing, decreasing, or otherwise altering the production of phenols and related compounds in plants. Examples of phenols and related compounds that can be altered according to the present invention include, but are not limited to, quinic acid and 4-hydroxy-benzoic acid. The alterations in metabolic profile are preferably accomplished by expressing one or more of the following nucleic acid sequences (or sequences that hybridize thereto) in a plant: 170074 (SEQ ID NO:335), 23242 (282), 25118 (SEQ ID NO:292), 25176 (SEQ ID NO:298), 25196 (SEQ ID NO:299), 27819 (SEQ ID NO:311), 30913 (SEQ ID NO:315), 37188 (SEQ ID NO:319), 45801 (SEQ ID NO:321), 45808 (SEQ ID NO:323), 45820 (SEQ ID NO:324), 45855 (SEQ ID NO:328), and 45864 (329). In preferred embodiments, expression in plants of the sequences that hybridize to the preceding sequences also results in an increase, decrease, or alteration of phenol and related compounds in a plant.

In some embodiments, the present invention provides methods and compositions for increasing, decreasing, or otherwise altering the production of sterols, oxygenated terpenes, and other isoprenoids in plants. Examples of sterols, oxygeneated terpenes, and other isoprenoids that can be altered according to the present invention include, but are not limited to, solanesol, cycloartenol, alpha-tocopherol, gamma-tocopherol, alpha-tocopherol quinone, beta-tocopherol, stigmast-7-en-3-ol (3b,5a,24S), cycloartenol, campesterol, cholesterol, beta-sitosterol, stigmasterol, 24-methylene-lophenol, 24-methylene-cycloartenol, 4,14-dimethyl-ergosta-8,24(28)-diene-3-ol, obtusifoliol, fucosterol, ergost-22-en-3-one, cycloartenol, stigmasta-5,22-dien-3-ol, and 24-methyl-3-oxo-29-norlanostan-10,11,24-methylenecholesterol. The alterations in metabolic profile are preferably accomplished by expressing one or more of the following nucleic acid sequences (or sequences that hybridize thereto) in a plant: 105039 (SEQ ID NO:334), 21604 (SEQ ID NO:281), 23242 (SEQ ID NO:282), 23869 (SEQ ID NO:282), 25124 (SEQ ID NO:293), 25196 (SEQ ID NO:299), 27410 (SEQ ID NO:303), 27819 (SEQ ID NO:311), 30913 (SEQ ID NO:315), 37188 (SEQ ID NO:319), 38919 (SEQ ID NO:320), 45801 (SEQ ID NO:321), 45808 (SEQ ID NO:323), 45864 (SEQ ID NO:329), and 56465 (SEQ ID NO:333). In preferred embodiments, expression in plants of the sequences that hybridize to the preceding sequences also results in an increase, decrease, or alteration of sterol, oxygenated terpene, and other isoprenoid production in a plant.

In some other preferred embodiments, the present invention comprises other nucleic acid sequences that either alter fatty acid when expressed in a plant. Sequences that altered fatty acid metabolism were identified using the FAME screen described below (see Example 12B). The FAME screen identifies the fatty acid composition of plant leaves that have been transformed with a viral vector comprising the nucleic acid sequences of the present invention. Sequences that alter levels of certain metabolites were identified using the metabolic screen described below (see Example 12E).

In some preferred embodiments, the present invention comprises SEQ ID NO: 94 and variants and orthologs thereof. Plants transformed with a viral vector comprising SEQ ID NO: 94 exhibited a stunted phenotype and had increased levels of 16:0 fatty acid methyl ester as identified by the FAME screen (see Example 12B). These plants were further analyzed using GC-MS (see Example 12E) to generate a metabolic profile. Gas chromatographs of leaf extracts were analyzed to identify compounds that were present at an increased level in transformed leaves relative to controls. The leaves exhibited increased levels of the following fatty acids: 18:1, 12:0, neophytadience, 14:0, and 16:1. The leaves also had increased levels of inositol, phosphoric acid, malic acid, ribonic acid, gamma-lactone, citric acid, quinic acid, and sugars. Furthermore, the plants were resistant to attack by insects (see Example 12C).

In some preferred embodiments, the present invention comprises SEQ ID NO: 43 and variants and orthologs thereof. Plants transformed with a viral vector comprising SEQ ID NO: 43 exhibited a stunted phenotype. The transfected plants were analyzed using GC-MS (see Example 12E) to generate a metabolic profile. Gas chromatographs of leaf extracts were analyzed to identify compounds that were present at an increased level in transformed leaves relative to controls. The plant leaves exhibited levels of glyceric acid, malic acid, ribonic acid, gamma-lactone, quinic acid, and inositol.

SEQ ID NO: 43 was compared to known sequences using the BLAST search program. This sequence was found to have homology to the maize ferridoxin:thioredoxin reductase (FTR; See for example, Iwadate et al., Eur. J. Biochem., 241:121 [1996]). FTR is the essential enzyme of the light-dependent regulatory system controlling enzyme activities in photosynthetic plant cells. FTR, in the presence of ferridoxin and thioredoxin, catalyzes the activation of several photosynthetic enzymes, such as fructose-1,6-biphosphatase and NADP-malate dehydrogenase (See for example, Tsugita et al., Protein seq Data Anal., 4:9 [1991]; and Crawford et al., Arch Biochem. Biophys, 271:223 [1989]). The present invention is not limited to a particular mechanism. Indeed, an understanding of the mechanism of the present invention is not necessary to practice the present invention. Nonetheless, it is contemplated that disrupting the regulation of photosynthetic enzymes by disrupting the function of FTR, is responsible for the stunting and phenotype and metabolic profile changes observed in plants transformed with viral vectors comprising SEQ ID NO: 43.

In some preferred embodiments, the present invention comprises SEQ ID NO: 151 and variants and orthologs thereof. Plants transformed with a viral vector comprising SEQ ID NO:151 exhibited a stunted phenotype and were found to have altered fatty acid metabolism as identified by the FAME screen (see Example 12B). The leaves also exhibited increased resistance to attack by insects (see Example 12C).

In some preferred embodiments, the present invention comprises SEQ ID NO: 52 and variants and orthologs thereof. Plants transformed with a viral vector comprising SEQ ID NO: 52 exhibited a stunted phenotype. The plants also exhibited altered fatty acid metabolism as identified by the FAME screen (see Example 12B).

SEQ ID NO: 52 was compared to known sequences using the BLAST search program. The sequence was found to have homology to *Arabidopsis thaliana* psbW gene (See for example, GenBank Accession Nos. S60662 and X90769). PsbW encodes the W subunit of photosystem II. PsbW is a thylakoid membrane protein that is part of the core photosystem II complex (See for example, Thompson et al., J. Biol. Chem., 273:18979 [1998]; Barber and Kuhlbrandt, Curr Opin Struct Biol 4:469 [1999]). The present invention is not limited to a particular mechanism. Indeed, an understanding of the mechanism of the present invention is not necessary to practice the present invention. Nonetheless, it is contemplated that disrupting the function of a component of plant photosynthesis, such as psbW, would disrupt plant growth and lead to the observed stunting phenotype and disrupted fatty acid metabolism.

In some preferred embodiments, the present invention comprises SEQ ID NO: 49 and variants and orthologs thereof. Plants transformed with a viral vector comprising SEQ ID NO: 49 exhibited a stunted phenotype. The plants also exhibited altered levels of certain metabolites as evidenced by the metabolic screen.

In some preferred embodiments, the present invention comprises SEQ ID NO: 79 and variants and orthologs thereof. Plants transformed with a viral vector comprising SEQ ID NO: 79 exhibited a stunted phenotype. The plants were further analyzed using GC-MS (see Example 12E) to generate a metabolic profile. Gas chromatographs of leaf extracts were analyzed to identify compounds that were present at an increased level in transformed leaves relative to controls. The plant leaves exhibited increased levels of malic acid, aspartic acid, pyroglutamate, citric acid, and sucrose.

SEQ ID NO: 79 was compared to known sequences using the BLAST search program. SEQ ID NO: 79 was found to have homology to *A. thaliana* H3 histone gene (See for example, Chaboute et al., Plant Mol. Biol., 8:179 [1987]). Histones are structural proteins involved in chromatin structure. The present invention is not limited to a particular mechanism. Indeed, an understanding of the mechanism of the present invention is not necessary to practice the present invention. Nonetheless, it is contemplated that disruption of chromosome structure is responsible for the stunting phenotype observed and for the increased level of certain metabolites.

IX. Identification of Homologs to Sequences

The present invention also provides homologs and variants of the sequences described above, but which may not hybridize to the sequences described above under conditions ranging from low to high stringency. In some preferred embodiments, the homologous and variant sequences are operably linked to an exogenous promoter. Table 1 provides BLAST search results from publicly available databases. The relevant sequences are identified by Accession number in these databases. Table 2 contains the top blastx hits (identified by accession number) versus all the amino acid sequences in the Derwent biweekly database. Table 3 contains the top blastn hits (identified by accession number) versus all the nucleotide sequences in the Derwent biweekly database.

TABLE 1

Blast Search Results for Selected Databases

| SEQ ID NO: | ID Number | Blast results |
|---|---|---|
| 334 | 105039 | sp|Q43848|TKTC_SOLTU TRANSKETOLASE, CHLOROPLAST PRECURSOR (TK)<br>emb|CAA90427.1| (Z50099) transketolase precursor [*Solanum tuberosum*] |
| 335 | 170474 | gb|AAK27804.1|AC022457_7 (AC022457) hypothetical protein [*Oryza sativa*] |
| 336 | 175736 | pir||T14544 fructokinase (EC 2.7.1.4) - beet<br>gb|AAA80675.1| (U37838) fructokinase [*Beta vulgaris*] |
| 280 | 182206 | pir||S58083 transketolase (EC 2.2.1.1) precursor - potato (fragment) |
| 281 | 21604 | pir||T45745 hypothetical protein F24M12.180 - *Arabidopsis thaliana*<br>emb|CAB62636.1| (AL132980) putative protein [*Arabidopsis thaliana*] |
| 282 | 23242 | gb|AAC73034.1| (AC005824) hypothetical protein [*Arabidopsis thaliana*] |
| 283 | 23869 | pir||S76514 hypothetical protein - Synechocystis sp. (strain PCC 6803)<br>dbj|BAA10360.1| (D64002) hypothetical protein [Synechocystis sp.] |
| 284 | 25004 | sp|O80934|Y230_ARATH PROTEIN AT2G37520, CHLOROPLAST PRECURSOR pir||T02532 hypothetical protein F13M22.16 - *Arabidopsis thaliana*<br>gb|AAC23636.1| (AC004684) unknown protein [*Arabidopsis thaliana*] |
| 285 | 25008 | sp|O80934|Y230_ARATH PROTEIN AT2G37520, CHLOROPLAST PRECURSOR<br>pir||T02532 hypothetical protein F13M22.16 - *Arabidopsis thaliana*<br>gb|AAC23636.1| (AC004684) unknown protein [*Arabidopsis thaliana*] |
| 286 | 25009 | sp|P55748|CP22_HORVU SERINE CARBOXYPEPTIDASE II-2 PRECURSOR (CP-MII.2)<br>gb|AAB31590.1| CP-MII.2 = serine carboxypeptidase [*Hordeum vulgare* = barley, cv. Alexis, aleurone, Peptide, 436 aa]<br>emb|CAB59202.1| (X78878) serine carboxylase II-2 [*Hordeum vulgare*] |
| 287 | 25011 | sp|P74707|RF1_SYNY3 PEPTIDE CHAIN RELEASE FACTOR 1 (RF-1) pir||S76914 translation releasing factor RF-1 - Synechocystis sp. (strain PCC 6803)<br>dbj|BAA18826.1| (D90917) peptide chain release factor [Synechocystis sp.] |
| 288 | 25015 | gb|AAG40037.1|AF324686_1 (AF324686) MSA6. [*Arabidopsis thaliana*]<br>gb|AAG41441.1|AF326859_1 (AF326859) unknown protein [*Arabidopsis thaliana*]<br>dbj|BAB01448.1| (AP000604) photosystem II 5 kD protein precursor [*Arabidopsis thaliana*]<br>gb|AAK00364.1|AF339682_1 (AF339682) unknown protein [*Arabidopsis thaliana*] |
| 289 | 25026 | sp|P27521|CB24_ARATH CHLOROPHYLL A-B BINDING PROTEIN 4 PRECURSOR (LHCI TYPE III CAB-4) (LHCP)<br>pir||T45707 CHLOROPHYLL A-B BINDING PROTEIN 4 PRECURSOR homolog - *Arabidopsis thaliana*<br>gb|AAA32760.1| (M63931) light-harvesting chlorophyll a/b binding protein [*Arabidopsis thaliana*]<br>emb|CAB61973.1| (AL132955) CHLOROPHYLL A-B BINDING PROTEIN 4 PRECURSOR homolog [*Arabidopsis thaliana*] |

TABLE 1-continued

Blast Search Results for Selected Databases

| SEQ ID NO: | ID Number | Blast results |
|---|---|---|
| 338 | 25057 | gb\|AAD25930.1\|AF085279_3 (AF085279) hypothetical Cys-3-His zinc finger protein [*Arabidopsis thaliana*] gb\|AAF18728.1\|AC018721_3 (AC018721) putative CCCH-type zinc finger protein [*Arabidopsis thaliana*] |
| 290 | 25062 | ref\|XP_011617.2\| golgi transport complex 1 (90 kDa subunit) [*Homo sapiens*] |
| 337 | 25080 | gb\|AAK52899.1\|AF351125_1 (AF351125) gamma-aminobutyrate transaminase subunit precursor [*Arabidopsis thaliana*] |
| 291 | 25104 | sp\|P15459\|2SS3_ARATH 2S SEED STORAGE PROTEIN 3 PRECURSOR (2S ALBUMIN STORAGE PROTEIN) pir\|\|NWMU3 2S albumin 3 precursor - *Arabidopsis thaliana* gb\|AAA32745.1\| (M22033) albumin 2S subunit 3 precursor [*Arabidopsis thaliana*] emb\|CAA80868.1\| (Z24744) 2S albumin isoform 3 [*Arabidopsis thaliana*] emb\|CAB38846.1\| (AL035680) NWMU3-2S albumin 3 precursor [*Arabidopsis thaliana*] emb\|CAB79571.1\| (AL161566) NWMU3-2S albumin 3 precursor [*Arabidopsis thaliana*] |
| 292 | 25118 | gb\|AAG50838.1\|AC073944_5 (AC073944) multispanning membrane protein, putative [*Arabidopsis thaliana*] |
| 293 | 25124 | gb\|AAK25908.1\|AF360198_1 (AF360198) putative ubiquitin carboxyl-terminal hydrolase [*Arabidopsis thaliana*] |
| 294 | 25133 | gb\|AAF78265.1\|AC020576_9 (AC020576) Contains similarity to aminoacylase from Sus scrofa domestica gi\|S27010 and contains a peptidase M20 PF\|01546 domain. ESTs gb\|H76043, gb\|AA394953, gb\|AI995115, gb\|AA651481 come from this gene. [*Arabidopsis thaliana*] |
| 295 | 25144 | dbj\|BAB01489.1\| (AB030033) AmiB [*Dictyostelium discoideum*] |
| 296 | 25164 | dbj\|BAB02817.1\| (AB024036) gene_id: MQC12.11~unknown protein [*Arabidopsis thaliana*] |
| 297 | 25170 | gb\|AAF78388.1\|AC069551_21 (AC069551) T10O22.12 [*Arabidopsis thaliana*] |
| 298 | 25176 | emb\|CAB44317.1\| (Y17842) lamin B receptor [*Xenopus laevis*] |
| 299 | 25196 | emb\|CAC08341.1\| (AL392174) lipoic acid synthase-like protein [*Arabidopsis thaliana*] |
| 339 | 25414 | emb\|CAB52750.1\| (AJ245632) photosystem I subunit VI precursor [*Arabidopsis thaliana*] gb\|AAF29410.1\|AC022354_9 (AC022354) photosystem I subunit VI precursor [*Arabidopsis thaliana*] |
| 300 | 25421 | gb\|AAD40603.1\|AF115283_22 (AF115283) preprotein translocase SecY [*Leptospira interrogans*] |
| 301 | 25425 | gb\|AAC32114.1\| (AF051209) CROC-1-like protein [*Picea mariana*] |
| 302 | 25431 | gb\|AAF86550.1\|AC069252_9 (AC069252) F2E2.14 [*Arabidopsis thaliana*] |
| 303 | 27410 | sp\|P24636\|TBB4_ARATH TUBULIN BETA-4 CHAIN pir\|\|S68122 tubulin beta-4 chain - *Arabidopsis thaliana* gb\|AAA32757.1\| (M21415) beta-tubulin [*Arabidopsis thaliana*] |
| 304 | 27424 | pir\|\|T01527 hypothetical protein A_IG005I10.23 - *Arabidopsis thaliana* gb\|AAB62841.1\| (AF013293) A_IG005I10.23 gene product [*Arabidopsis thaliana*] gb\|AAF02799.1\|AF195115_19 (AF195115) F5I10.23 gene product [*Arabidopsis thaliana*] emb\|CAB80802.1\| (AL161471) putative protein [*Arabidopsis thaliana*] |
| 305 | 25427 | pir\|\|T49105 symbiosis-related like protein - *Arabidopsis thaliana* emb\|CAA18101.1\| (AL022140) symbiosis-related like protein [*Arabidopsis thaliana*] emb\|CAB79153.1\| (AL161556) symbiosis-related like protein [*Arabidopsis thaliana*] |
| 306 | 27430 | pir\|\|T24470 hypothetical protein T04F8.8 - *Caenorhabditis elegans* emb\|CAA91483.1\| (Z66565) cDNA EST yk121f1.5 comes from this gene~cDNA EST yk145f11.3 comes from this gene~cDNA EST yk150b6.3 comes from this gene~cDNA EST yk150b6.5 comes from this gene~cDNA EST yk171h2.5 comes from this gene~cDNA EST yk205f7.3 comes from this gene |
| 307 | 27440 | gb\|AAB03512.1\| (L37749) hexokinase III [*Homo sapiens*] |
| 308 | 27459 | gb\|AAF87848.1\|AC073942_2 (AC073942) Contains similarity to a hypothetical protein T11I11.11 gi\|6587865 from Arabidopsis thaliana BAC gb\|AC012680 |

TABLE 1-continued

Blast Search Results for Selected Databases

| SEQ ID NO: | ID Number | Blast results |
|---|---|---|
| 309 | 27460 | sp\|Q9ZAE3\|RL18_THEMA 50S RIBOSOMAL PROTEIN L18 pir\|D72248 ribosomal protein L18 - *Thermotoga maritima* (strain MSB8) gb\|AAD36550.1\|AE001798_15 (AE001798) ribosomal protein L18 [*Thermotoga maritima*] |
| 310 | 27468 | gb\|AAF97342.1\|AC023628_23 (AC023628) Putative MYB family transcription factor [*Arabidopsis thaliana*] |
| 311 | 27819 | pir\|S56707 histone H3 homolog - common tobacco |
| 312 | 27864 | pir\|T02580 hypothetical protein T16B24.14 - *Arabidopsis thaliana* gb\|AAC28986.1\| (AC004697) putative patatin protein [*Arabidopsis thaliana*] |
| 313 | 30087 | gb\|AAC72288.1\| (AF033204) putative pectin methylesterase [*Arabidopsis thaliana*] |
| 314 | 30307 | ref\|NP_064380.1\| phosphorylated adaptor for RNA export [*Mus musculus*] emb\|CAB87994.1\| (AJ276504) phosphorylated adaptor for RNA export [*Mus musculus*] |
| 315 | 30913 | gb\|AAA73163.1\| (M81126) synthetic fusion protein [synthetic construct] |
| 316 | 34136 | gb\|AAB82617.1\| (AC002387) unknown protein [*Arabidopsis thaliana*] |
| 317 | 34442 | pir\|T48166 hypothetical protein T10O8.150 - *Arabidopsis thaliana* emb\|CAB81927.1\| (AL161746) putative protein [*Arabidopsis thaliana*] |
| 318 | 37186 | pir\|T09015 transketolase (EC 2.2.1.1) precursor, chloroplast - spinach gb\|AAD10219.1\| (L76554) transketolase [*Spinacia oleracea*] |
| 319 | 37188 | pir\|RGUS1M exonuclease REC1 (EC 3.1.- .- ) - smut fungus (*Ustilago maydis*) |
| 320 | 38919 | pir\|UQFS ubiquitin precursor - common sunflower (fragment) |
| 321 | 45801 | dbj\|BAA97024.1\| (AB024035) 30S ribosomal protein S16 [*Arabidopsis thaliana*] |
| 322 | 45804 | emb\|CAA05084.1\| (AJ001911) putative Ckc2 [*Arabidopsis thaliana*] |
| 323 | 45808 | gb\|AAF80126.1\|AC024174_8 (AC024174) Contains similarity to a fructokinase from Solanum tuberosum gi\|585973 and is a member of the pfkB carbohydrate kinase family PF\|00294. [*Arabidopsis thaliana*] |
| 324 | 45820 | sp\|Q43291\|RL21_ARATH 60S RIBOSOMAL PROTEIN L21 gb\|AAB60725.1\| Similar to ribosomal protein L21 (gb\|L38826). ESTs gb\|AA395597, gb\|ATTS5197 come from this gene. [*Arabidopsis thaliana*]gb\|AAC33220.1\|AAC33220 (AC003970) Putative ribosomal protein L21 [*Arabidopsis thaliana*] gb\|AAK44042.1\|AF370227_1 (AF370227) putative ribosomal protein L21 [*Arabidopsis thaliana*] |
| 325 | 45837 | dbj\|BAB02573.1\| (AP001299) gene_id: F4B12.10~unknown protein [*Arabidopsis thaliana*] |
| 326 | 45850 | gb\|AAG51729.1\|AC068667_8 (AC068667) unknown protein; 16040-11188 [*Arabidopsis thaliana*] |
| 327 | 45853 | sp\|P92792\|OM20_SOLTU MITOCHONDRIAL IMPORT RECEPTOR SUBUNIT TOM20 (TRANSLOCASE OF OUTER MEMBRANE 20 KDA SUBUNIT) pir\|T07679 protein import receptor TOM20, mitochondrial potato emb\|CAA63223.1\| (X92491) TOM20 [*Solanum tuberosum*] |
| 328 | 45855 | gb\|AAF99832.1\|AC008046_4 (AC008046) Putative ribosomal protein [*Arabidopsis thaliana*] gb\|AAK48976.1\|AF370549_1 (AF370549) Putative ribosomal protein [*Arabidopsis thaliana*] |
| 329 | 45864 | pir\|T05075 hypothetical protein T6K21.70 - *Arabidopsis thaliana* emb\|CAA17132.1\| (AL021889) putative protein [*Arabidopsis thaliana*] emb\|CAB78791.1\| (AL161547) putative protein [*Arabidopsis thaliana*] |
| 330 | 45866 | sp\|Q9ZSW9\|TCTP_HEVBR TRANSLATIONALLY CONTROLLED TUMOR PROTEIN HOMOLOG (TCTP) gb\|AAD10032.1\| (AF091455) translationally controlled tumor protein [*Hevea brasiliensis*] |
| 331 | 45869 | dbj\|BAB01276.1\| (AB023046) proline-rich protein APG-like; GDSL-motif lipase/hydrolase-like protein [*Arabidopsis thaliana*] |
| 332 | 45874 | pir\|T51279 ribosomal protein, chloroplast - *Arabidopsis thaliana* emb\|CAC00754.1\| (AL390921) ribosomal protein, chloroplast [*Arabidopsis thaliana*] |
| 333 | 56465 | pir\|T47886 transketolase-like protein - *Arabidopsis thaliana* emb\|CAB82679.1\| (AL162295) transketolase-like protein [*Arabidopsis thaliana*] |

TABLE 2

| SEQ ID NO. | ID Number | Accession Numbers of Hits |
|---|---|---|
| 334 | 105039 | AAB10624; AAW03319; AAG40462; AAG31692; AAG31693; AAB10624; AAW03319; AAG31691; AAG28890; AAG15242 |
| 335 | 170474 | AAG12800; AAG12801; AAG29067; AAG12802; AAG52408; AAG12802; AAG12800; AAG12801; AAG52414; AAG52416 |
| 336 | 175736 | AAW81786; AAG17112; AAG09068; AAB46419; AAB46419; AAG17114; AAG09070; AAG17112; AAG09068; AAG17113 |
| 280 | 182206 | AAG08581; AAG15243; AAG15242; AAG15244; AAG40461 |
| 281 | 21604 | AAG60253; AAG57855; AAG60254; AAG57856; AAG58553 |
| 283 | 23869 | AAG58058; AAG58083; AAG58059; AAG58059 |
| 285 | 25008 | AAG37867; AAG18287; AAG37866; AAG18286 |
| 286 | 25009 | AAG47179; AAG47178; AAG47177; AAG23906; AAG23905 |
| 287 | 25011 | AAG29027; AAG29026; AAG29028; AAY70144; AAW29380 |
| 288 | 25015 | AAG43616; AAG43614; AAG43615; AAG14253; AAG14254 |
| 289 | 25026 | AAG53842; AAG08988; AAG53841; AAG08987; AAG53843 |
| 338 | 25057 | AAG31643; AAG31641; AAG31642; AAG61071; AAG61072 |
| 290 | 25062 | AAR89750 |
| 337 | 25080 | AAB19490; AAG16448; AAG16449; AAG16450; AAG33444; AAB19490; AAG16448; AAG16450; AAG16449; AAG35991 |
| 291 | 25104 | AAP96144; AAP91892; AAW23588; AAW23586; AAR33390 |
| 292 | 25118 | AAG43743; AAG43745; AAG43744; AAG04118; AAG31959 |
| 293 | 25124 | AAY86227; AAY35651; AAY37290 |
| 294 | 25133 | AAG50167; AAG50168; AAG50166; AAG06513; AAG06511; AAG50167; AAG06512; AAG50166; AAG06511; AAG33534 |
| 295 | 25144 | AAG57079; AAB16305; AAR39299; AAB16306; AAB18198; |
| 296 | 25164 | AAG39753; AAG29096; AAG39752; AAG29095 |
| 297 | 25170 | AAG38679; AAG38680; AAG27620; AAG38681; AAG27621 |
| 298 | 25176 | AAB63719; AAR93610; AAR97834; AAG07743 |
| 299 | 25196 | AAG48727; AAG05244; AAG48728; AAG05245; AAG48729 |
| 339 | 25414 | AAG10794; AAG47347; AAG54914; AAG47312; AAG10974; AAG54914; AAG47312; AAG10974 |
| 300 | 25421 | AAG31569; AAY95040 |
| 301 | 25425 | AAG39142; AAG39143; AAG08248; AAG54876; AAG39144 |
| 302 | 25431 | AAG16710; AAG16709; AAG16711; AAG47573; AAG41227 |
| 303 | 27410 | AAG47010; AAG47008; AAG47009; AAG42988; AAG17036 |
| 304 | 27424 | AAG59539; AAG59538; AAG59537; AAG22267 |
| 305 | 25427 | AAG47987; AAG47990; AAG47988 |
| 306 | 27430 | AAG44675; AAG44673; AAG44674; AAG51796; AAG29999 |
| 307 | 27440 | AAW75919; AAG41126; AAW13670; AAY65872 |
| 308 | 27459 | AAG21756; AAG21757; AAG21755; AAG34822; AAG34823 |
| 309 | 27460 | AAG52634; AAG09437; AAG52635; AAG09438; AAG09943 |
| 310 | 27468 | AAG14730; AAG14731; AAG19773; AAG19774 |
| 311 | 27819 | AAG12083; AAG47929; AAG36934; AAG26859; AAG36935 |
| 312 | 27864 | AAG54013; AAG54014; AAG54015; AAG05196; AAG05197 |
| 313 | 30087 | AAG14746; AAG14744; AAG14745; AAW72963; AAW12660 |
| 314 | 30307 | AAY87788; AAY78855; AAY34917; AAY93184 |
| 315 | 30913 | AAB04162; AAR10474; AAR21552; AAR21553 |
| 316 | 34136 | AAG43687; AAG43685; AAG43686 |
| 317 | 34442 | AAG31677; AAG31678; AAG31679; AAW95039; AAY35611 |
| 318 | 37186 | AAG31691; AAG40462; AAG40461; AAG31692; AAG40460 |
| 319 | 37188 | AAB47020; AAG44658; AAG44659; AAG44660 |
| 320 | 38919 | AAG44760 |
| 321 | 45801 | AAG24483; AAG20434; AAG39213; AAG39214; AAG24484 |

TABLE 2-continued

| SEQ ID NO. | ID Number | Accession Numbers of Hits |
|---|---|---|
| 322 | 45804 | AAG49622; AAG07101; AAG49621; AAG07100 |
| 323 | 45808 | AAG10313; AAG10314; AAG10315; AAG17114; AAG09070 |
| 324 | 45820 | AAG24999; AAG25000; AAG43611; AAG47669; AAG27986 |
| 325 | 45837 | AAG26406; AAG26407; AAY71916 |
| 327 | 45853 | AAG51530; AAG08042; AAG51531; AAG08043; AAG11383 |
| 328 | 45855 | AAG25047; AAG23219; AAG11189; AAG09821; AAG09820 |
| 329 | 45864 | AAG25072; AAG25071; AAG25070; AAG52744; AAG52745 |
| 330 | 45866 | AAG41955; AAG04532; AAG35568; AAG54578; AAG54502 |
| 331 | 45869 | AAG45664; AAG26188; AAG26186; AAG26187; AAG45663 |
| 332 | 45874 | AAG26336; AAG19244; AAG13376; AAG54975; AAG16267 |
| 333 | 56465 | AAG09847; AAG09848; AAG08581 |

TABLE 3

| SEQ ID NO: | ID Number | Nucleic Acid Blast Hits |
|---|---|---|
| 334 | 105039 | AAA71793; AAT35903; AAC46455; AAC43120; AAC36886; AAA71793; AAT35903; AAF61220; AAF61219; AAF61218 |
| 335 | 170474 | AAC35963; AAC50920; AAC50918; AAC42162; AAC35963; AAV64625; AAC37608; AAC34496; AAF66834 |
| 336 | 175736 | AAA67291; AAA67287; AAA67285; AAA67288; AAA67278; AAA67275; AAZ43885; AAZ43880 |
| 280 | 182206 | AAA71793; AAT35903; AAC34305 |
| 281 | 21604 | AAC54480; AAC53467; AAZ86878; AAZ40799; AAV15082 |
| 282 | 23242 | AAC88116; AAC78052; AAC77093; AAX90201 |
| 283 | 23869 | AAC53550; AAC53560; AAC54140; AAC52688 |
| 285 | 25008 | AAC45476; AAC38055; AAC46141; AAC43179; AAC35309; |
| 286 | 25009 | AAC48966; AAC40187; AAZ46156; AAC47963; AAV57911 |
| 287 | 25011 | AAC42148; AAC79885; AAC53894; AAC32896; AAF28551 |
| 288 | 25015 | AAC47630; AAC36501; AAC51267; AAC46968; AAA27678 |
| 289 | 25026 | AAC51455; AAC34464; AAC46521; AAC51766; AAX13230 |
| 338 | 25057 | AAC77474; AAX41515; AAC50747; AAC33928; AAX91990; AAA47316; AAF32205; AAA81575; AAF15915 |
| 290 | 25062 | AAT34660; AAC79951; AAC64370; AAX91990; AAX99575 |
| 337 | 25080 | AAC37361; AAC62026; AAC43789; AAZ28374; AAC62028; AAC37361; AAC62026; AAC44199 |
| 291 | 25104 | AAN90116; AAN91903 |
| 292 | 25118 | AAC43220; AAC32617; AAC47678 |
| 293 | 25124 | AAF09844; AAV68142; AAX20248; AAT70813; AAT17981 |
| 294 | 25133 | AAC50085; AAC33510; AAC79623; AAT74200; AAC50085; AAC33510; AAC43825; AAC03410; AAQ33106 |
| 295 | 25144 | AAC47787; AAC48287; AAC53139; AAC40672 |
| 296 | 25164 | AAC46192; AAC42171; AAC42036; AAC53237 |
| 297 | 25170 | AAC49111; AAC39852; AAC43994; AAC49101; AAT42063 |
| 298 | 25176 | AAC48552; AAC46307; AAC45561; AAC35280; AAC33374 |
| 299 | 25196 | AAC49548; AAC33043; AAC44589 |
| 339 | 25414 | AAC35174; AAC49030; AAC49017; AAC52025; AAF68242; AAC52025; AAC49017; AAC51815 |
| 300 | 25421 | AAF76597; AAF45152; AAF45151; AAF45144 |
| 301 | 25425 | AAC34171; AAC45956; AAC51987; AAC35101 |
| 302 | 25431 | AAC37460; AAZ35273; AAC44705; AAA93919; AAX20248 |

TABLE 3-continued

| SEQ ID NO: | ID Number | Nucleic Acid Blast Hits |
|---|---|---|
| 303 | 27410 | AAC48904; AAC47026; AAC40829; AAC47401; AAC37579 |
| 304 | 27424 | AAC54087; AAC39572; AAC41582; AAC54192; AAA46327 |
| 305 | 25427 | AAC49271; AAC36469; AAC49272; AAC34314; AAF22305 |
| 306 | 27430 | AAC47114; AAC49141; AAC49134 |
| 307 | 27440 | AAX20560; AAF28099; AAF26320; AAA34915; 34914 |
| 308 | 27459 | AAX99592; AAX23321; AAC84836; AAC84826; AAC89559 |
| 309 | 27460 | AAC51007; AAC34646; AAC34838; AAC36205 |
| 310 | 27468 | AAC36683; AAX90605; AAV25602 |
| 311 | 27819 | AAC41085; AAC47648; AAC36131; AAC43614; AAC34045 |
| 312 | 27864 | AAF24298; AAT14180; AAF67765; AAC08621 |
| 313 | 30087 | AAC36689; AAV64073; AAT51738; AAV64074; AAT51739 |
| 314 | 30307 | AAX91990; AAV57903; AAT22884; AAC44294; AAC38980 |
| 315 | 30913 | AAF24901; AAA56091 |
| 316 | 34136 | AAC40341; AAC47656; AAC38809; AAQ98471; AAC38809; AAC47656; AAC55902; AAC74238; AAX13009 |
| 317 | 34442 | AAT12557; AAT34617; AAA44222; AAC59611; AAF65936 |
| 318 | 37186 | AAC46455; AAC43120; AAC36886; AAC34801; AC34305; |
| 319 | 37188 | AAC85282; AAC79694; AAC83002; AAX76329 |
| 320 | 38919 | AAF22305 |
| 321 | 45801 | AAC40401; AAC38898 |
| 322 | 45804 | AAC49881; AAC33732; AAC54301; AAC56824 |
| 323 | 45808 | AAC34977; AAV64626; AAC82994; AAC34496 |
| 324 | 45820 | AAC40597; AAC37179; AAC47629; AAC41759; AAC49148 |
| 325 | 45837 | AAC41154; AAF75866; AAF75865; AAC76913; AAF22305 |
| 326 | 45850 | AAV80117; AAV80181 |
| 327 | 45853 | AAC50591; AAC34094; AAC52632; AAC35406 |
| 328 | 45855 | AAC40616; AAC52091; AAC35334; AAC39935 |
| 329 | 45864 | AAC40625; AAC51049; AAC44350 |
| 330 | 45866 | AAC47019; AAC32771; AAC53835; AAC44612; AAC51854 |
| 331 | 45869 | AAC48403; AAC41073; AAC49977; AAC52157; AAA35030 |
| 332 | 45874 | AAC51906; AAC41128; AAC38438 |
| 333 | 56465 | AAC36886; AAC34305 |

In addition, the nucleic acid sequences were analyzed using Pfam analysis. The nucleic acid sequences giving stunting phenotypes were further analyzed by translating the sequences into their predicted amino acid sequences. The predicted amino acid sequences were used to search amino acid databases to identify protein homologs and orthologs. One skilled in the art recognizes that a nucleic acid sequence can be translated in one of three reading frames. However, all of the amino acid sequences identified herein have substantial homology to the homolog or ortholog. Therefore, it is contemplated that in some embodiments the amino acid sequences presented herein are translated in the correct reading frame.

A. Fructokinase

In some embodiments, the present invention comprises sequences identified as having homology to fructokinase. Table 4 shows putative fructokinase enzymes, identified through Pfam searches and searches for protein orthologs and homologs. Table 4 lists sequence identification for the nucleic acid sequence, the Pfam score and P-value, and sequence identification for protein orthologs and homologs for all sequences identified as fructokinases.

Fructokinase is involved in the metabolism of simple sugars in plants. Sucrose translocated from leaves to sink tissue may be stored directly or metabolized by Sucrose synthase and/or invertase to provide hexose and hexose phosphate for storage or metabolism. In both Sucrose synthase- and invertase-mediated metabolic pathways, Fructose is formed as a metabolic product and must be phosphorylated for further metabolism. Two enzymes, hexokinase and fructokinase are able to phosphorylate Fructose in plants. Hexokinase can effectively utilize several hexoses, including Fructose and Glucose, whereas fructokinase specifically phosphorylates fructose. Fructokinase is likely to be of primary importance in phosphorylation of fructose in plants because the affinity of fructokinase for fructose is much higher than that of hexokinase.

TABLE 4

Fructokinase Sequences

| SEQ ID NO | PFam Score | P-Value | Ortholog/Homolog SEQ ID NO |
|---|---|---|---|
| 101 | 17.9 | 0.00011 | 167877; 123 |
| 105 | 26.7 | 1.8e-07 | 187756; 167877 |
| 120 | 139.9 | 5.9e-43 | 123; 190868; 130; 167877 |
| 122 | 127 | 6.4e-39 | 123; 190868; 130 |
| 123 | 143.5 | 4.4e-44 | 190868 |
| 126 | 38.8 | 3e-11 | 186915 |
| 128 | 16.8 | 0.000240 | 186915; 167955; 105 |

TABLE 4-continued

Fructokinase Sequences

| SEQ ID NO | PFam Score | P-Value | Ortholog/Homolog SEQ ID NO |
|---|---|---|---|
| 130 | 94.6 | 9.1e-29 | 190868 |
| 133 | 34.3 | 7.7e-10 | 190868 |
| 134 | 34.3 | 7.7e-10 | 133 |
| 137 | 94.9 | 7.4e-29 | 190868; 130 |
| 149 | 97.1 | 97.1 | 190868; 130; 19086; 123 |

B. Transketolase

In some embodiments, the present invention comprises sequences identified as having homology to transketolase. Table 5 shows putative fructokinase enzymes, identified through Pfam searches and searches for protein orthologs and homologs. Table 5 lists sequence identification for the nucleic acid sequence, the Pfam score and P-value, and sequence identification for protein orthologs and homologs for all sequences identified as having homology to transketolases.

TABLE 5

Transketolase Sequences

| SEQ ID NO | PFam Score | P-Value | Ortholog/Homolog SEQ ID NO |
|---|---|---|---|
| 81 | 30.6 | 2.7e-7 | 124; 130065 |
| 85 | 235.9 | 5.8e-67 | 144; 140 |
| 118 | 113.8 | 3.3e-30 | 30310; 144 |
| 119 | 19.9 | 0.00018 | 129 |
| 121 | 162.7 | 6e-45 | 146; 145; 143 |
| 124 | 150.8 | 2.4e-41 | 140; 85 |
| 125 | 347.8 | 1.2e-100 | 182731; 148; 141 |
| 127 | 125.3 | 1.1e-33 | 129; 97 |
| 129 | 189.3 | 5.9e-53 | 97 |
| 131 | 193.8 | 2.7e-54 | 129; 97 |
| 132 | 174.7 | 1.6e-48 | 85; 144; 140 |
| 135 | 291.7 | 9e-84 | 130; 190868; 30310; 140; 144; 123 |
| 138 | 159.1 | 7.7e-44 | 129; 97 |
| 139 | 159.1 | 7.7e-44 | 129; 97 |
| 140 | 232 | 8.5e-66 | 85; 144 |
| 141 | 335.6 | 5.6e-97 | 148; 143 |
| 142 | 81 | 1.1e-20 | 145 |
| 143 | 323.6 | 2.3e-93 | 148; 141; 143 |
| 144 | 191.4 | 1.4e-53 | 85; 140 |
| 145 | 225.2 | 9.5e-64 | 141; 143; 148 |
| 146 | 228.9 | 7.1e-65 | 143; 141 |
| 147 | 220 | 3.6e-62 | 182731; 140; 124 |
| 148 | 352.5 | 4.5e-102 | 182731 |

Transketolase is a key enzyme of the non-oxidative pentose phosphate pathway. The effect of its overexpression on aromatic amino acid production was investigated in *Corynebacterium glutamicum*, a typical amino-acid-producing organism. For this purpose, the transketolase gene of the organism was cloned on the basis of its ability to complement a *C. glutamicum* transketolase mutant with pleiotropically shikimic-acid-requiring, ribose- and gluconic-acid-negative phenotype. A cDNA encoding the Calvin cycle enzyme transketolase was isolated from *Sorghum* bicolor via subtractive differential hybridization, and used to isolate several full-length cDNA clones for this enzyme from spinach. Functional identity of the encoded mature subunit was shown by an 8.6-fold increase of TKL activity upon induction of *Escherichia coli* cells that overexpress the spinach TKL subunit under the control of the bacteriophage T7 promoter. Chloroplast localization of the cloned enzyme is shown by processing of the in vitro synthesized precursor upon uptake by isolated chloroplasts. Southern blot-analysis suggests that TKL is encoded by a single gene in the spinach genome. TKL proteins of both higher-plant chloroplasts and the cytosol of non-photosynthetic eukaryotes are found to be unexpectedly similar to eubacterial homologues, suggesting a possible eubacterial origin of these nuclear genes. Chloroplast TKL is the last of the demonstrably chloroplast-localized Calvin cycle enzymes to have been cloned and thus completes the isolation of gene probes for all enzymes of the pathway in higher plants.

C. Ferritin

In some embodiments, the present invention comprises sequences identified as having homology to ferritin. Table 6 shows putative ferritin proteins, identified through Pfam searches and searches for protein orthologs and homologs. Table 6 lists sequence identification for the nucleic acid sequence, the Pfam score and P-value, and sequence identification for protein orthologs and homologs for all sequences identified as having homology to ferritin.

Iron-regulated ferritin synthesis in animals is dominated by translational control of stored mRNA; iron-induced transcription of ferritin genes, when it occurs, changes the subunit composition of ferritin mRNA and protein and is coupled to translational control. Ferritins in plants and animals have evolved from a common progenitor, based on the similarity of protein sequence; however, sequence divergence occurs in the C termini; structure prediction suggests that plant ferritin has the E-helix, which, in horse ferritin, forms a large channel at the tetrameric interface. In contemporary plants, a transit peptide is encoded by ferritin mRNA to target the protein to plastids. Iron-regulated synthesis of ferritin in plants and animals appears to be very different since the 50- to 60-fold increases of ferritin protein, previously observed to be induced by iron in cultured soybean cells, is accompanied by an equivalent accumulation of hybridizable ferritin mRNA and by increased transcription of ferritin genes. Ferritin mRNA from iron-induced cells and the constitutive ferritin mRNA from soybean hypocotyls are identical. The iron-induced protein is translocated normally to plastids. Differences in animal ferritin structure coincide with the various iron storage functions (reserve for iron proteins and detoxification). In contrast, the constancy of structure of soybean ferritin, iron-induced and constitutive, coupled with the potential for vacuolar storage of excess iron in plants suggest that rapid synthesis of ferritin from a stored ferritin mRNA may not be needed in plants for detoxification of iron.

A synthetic siderophore, O-Trensox (L), has been designed and synthesized to improve iron nutrition of plants. The affinity for iron of this ligand [pFe(III)=29.5 and pFe(II)=17.9] is very high compared with EDTA. In spite of its high and specific affinity for iron, O-Trensox was found to be able to prevent, and to reverse, iron chlorosis in several plant species grown in axenic conditions. It also allows the iron nutrition and growth of *Acer pseudoplatanus* L. cell suspensions. The rate of iron metabolization was monitored by $^{59}$Fe radioiron. Ferritins the iron storage proteins, are shown to be the first iron-labelled proteins during iron metabolization and to be able to further dispatch the metal. Using Fe(III-Trensox, the rate of iron incorporation into ferritin was found to be higher than when using Fe-EDTA, but slower than with Fe-citrate, the natural iron carrier in xylem. During a plant cell culture, the extracellular concentrations of iron complex and fiee ligand were measured; changes in their relative amounts showed that the iron complex is dissociated extracellularly and that only iron is internalized. This suggests a high affinity for iron of a putative carrier on the plasmalemma. In contrast with Fe-citrate and Fe-EDTA complexes, Fe(III)Trensox is not photoreducible. Its ability to induce radical damage as a Fenton reagent was tested using supercoiled DNA as target molecule. Unlike Fe-citrate and Fe-EDTA, Fe(II)Trensox and Fe(III)-Trensox were proven to be harmless even during ascorbate-driven reduction, while Fe-EDTA and Fe-citrate generate heavy damage to DNA.

TABLE 6

Ferritin Sequences

| SEQ ID NO | PFam Score | P-Value | Ortholog/ Homolog SEQ ID NO |
|---|---|---|---|
| 33 | 66.1 | 1.2e−18 | |
| 34 | 66.1 | 1.2e−18 | 33; 25152 |

X. Contigs and Orthologs Identified by Sequence Analysis

In some embodiments, the present invention comprises nucleic acid sequences (contigs) assembled from SEQ ID NOs:1-154 (See FIG. 1) described above. Contigs were assembled by a computer program configured to match sequences with at least a 50 nucleotide overlap with at least 93% exact homology. The sequences for these contigs are provided in FIG. 2.

Contig 1 (Sequence ID NO: 155) (633 nucleotides) was assembled from SEQ ID NO: 120 and SEQ ID NO: 101. Sequence analysis of contig 1 revealed homology to a Fructokinase (GenBank accession NO: T07588).

Contig 2 (Sequence ID NO: 156) (1127 nucleotides) was assembled from SEQ ID NO: 132, SEQ ID NO: 131, SEQ ID NO: 139 and SEQ ID NO: 138. Sequence analysis of contig 2 revealed homology to a Chloroplast Transketolase (NO: Q42676).

Contig 3 (Sequence ID NO: 157) (1991 nucleotides) was assembled from SEQ ID NO: 132, SEQ ID NO: 145, SEQ ID NO: 146, SEQ ID NO: 141, SEQ ID NO: 143, SEQ ID NO: 148, SEQ ID NO: 147, SEQ ID NO: 140, SEQ ID NO: 135 and SEQ ID NO: 144. Sequence analysis of contig 3 revealed homology to a Chloroplast Transketolase Precursor (GenBank accession NO: Q43848).

Contig 4 (Sequence ID NO: 158) (607 nucleotides) was assembled from SEQ ID NO: 133 and SEQ ID NO: 134. Sequence analysis of contig 4 revealed homology to a Guanosine Kinase (GenBank accession NO: BAA23613).

Contig 5 (Sequence ID NO:159) (452 nucleotides) was assembled from SEQ ID NO: 7 and SEQ ID NO: 6. Sequence analysis of contig 5 reveals homology to a hypothetical protein from A. thaliana (GenBank accession NO: T02532).

Contig 6 (Sequence ID NO: 160) (391 nucleotides) was assembled from SEQ ID NO: 9 and SEQ ID NO: 15. Sequence analysis of contig 6 reveals homology to a Translation Releasing Factor, RF-1 like protein from A. thaliana (GenBank accession NO: CAB87736).

Contig 8 (Sequence ID NO:162) (800 nucleotides) was assembled from SEQ ID NO: 33 and SEQ ID NO: 34. Sequence analysis of contig 08 reveals homology to a putative Ferritin Subunit Precursor (GenBank accession NO: AC009991).

Contig 10 (Seq ID NO: 164) (771 nucleotides) was assembled from SEQ ID NO: 22 and SEQ ID NO: 13.

Sequence analysis of contig 10 reveals homology to a hypothetical A. thaliana protein (GenBank accession NO: T04685).

Contig 12 (Sequence ID NO: 165) (633 nucleotides) was assembled from SEQ ID NO: 130 and SEQ ID NO: 149. Sequence analysis of contig 12 reveals homology to a Fructokinase from A. thaliana (GenBank accession NO: T01971).

Contig 13 (Sequence ID NO: 166) (581 nucleotides) was assembled from SEQ ID NO: 50 and SEQ ID NO: 45. Sequence analysis of contig 13 reveals homology to an ATP11a Peroxidase from A. thaliana (GenB ank accession NO: CAA67334).

Contig 14 (Sequence ID NO: 167) (701 nucleotides) was assembled from SEQ ID NO: 53 and SEQ ID NO: 43. Sequence analysis of contig 14 reveals homology to a Ferridoxin-Thioredoxin Reductase Subunit A from Zea maize (GenBank accession NO: P80680).

Contig 15 (Sequence ID NO: 168) (693 nucleotides) was assembled from SEQ ID NO: 129 and SEQ ID NO: 127. Sequence analysis of contig 15 reveals homology to a Chloroplast Transketolase Precursor (GenBank accession NO: Q43848).

Contig 16 (Sequence ID NO: 169) (504 nucleotides) was assembled from two copies of Seq ID NO: 67. Sequence analysis of contig 16 reveals homology to a hypothetical protein, F17K2.25, from A. thaliana (GenBank accession NO: T02475).

Contig 17 (Sequence ID NO: 170) (1626 nucleotides) was assembled from SEQ ID NO: 121, SEQ ID NO: 125, SEQ ID NO: 81 and SEQ ID NO: 124. Sequence analysis of contig 17 reveals homology to Chloroplast Precursor Transketolase (GenBank accession NO: Q43848).

Contig 20 (Sequence ID NO: 171) (649 nucleotides) was assembled from SEQ ID NO: 122 and SEQ ID NO: 123. Sequence analysis of contig 20 reveals homology to a Fructokinase from L. esculentum (GenBank accession NO: AAB51108).

In other embodiments, the present invention comprises nucleic acids corresponding to contigs developed by searching a nucleic acid database (this database contains other sequences developed for the screening programs as described in the Examples) for sequences having homology at the amino acid level. These sequences were then assembled into contigs based on sequence overlaps and a consensus nucleic acid sequence was developed. These contigs are provided in FIGS. 3 and 4 and correspond to SEQ ID NOs.: 172-216.

In still further embodiments, the present invention provides orthologs identified by searching the nucleic acid database for homologous sequences. These orthologs, SEQ ID NOs: 217-280, are provided in FIG. 5.

In addition, a blast search of the sequence database at a stringency of e-20 was conducted with SEQ ID NOs:281-343. This led to the identification of the contig and singleton sequences listed in FIG. 9, SEQ ID NOs:344-571.

As will be understood by those skilled in the art, the present invention is not limited to the particular sequences of the contigs and orthologs described above. Indeed, the present invention encompasses portions, fragments, and variants of the contigs and orthologs as described above. Such variants, portions, and fragments can be produced and identified as described in Section III above. In particularly preferred embodiments, the present invention provides sequences that hybridize to SEQ ID NOs: 155-280 and 344-571 under conditions ranging from low to high stringency. In other preferred embodiments, the present invention provides nucleic acid sequences that inhibit the binding of SEQ ID NOs:155-280 and 344-571 under conditions ranging from low to high stringency. Furthermore, as described above in Section IV, the contigs and orthologs can be incorporated into vectors for expression in a variety of hosts, including transgenic plants.

XI. Sequences Conferring Pesticidal Resistance or Tolerance

The present invention also provides nucleic acid sequences that confer resistance or tolerance to pests and insects. It is contemplated that expression of these polypeptides in plants reduces the susceptibility of plants to damage by insects or pests. In preferred embodiments, nucleic acids that confer insect tolerance or resistance to plants are selected from SEQ ID NOs: 3, 150, 151, 26, 31, 36, 58, 78, 94, 106, 107, 110, 112, 113, 114, 117, 123. These sequences were identified in the insect screen described below (see Example 12C). The present invention is not limited to any particular mechanism of action. Indeed, an understanding of the mechanism of action is not necessary to practice the present invention. However, it is believed that expression of the nucleic acids in plants can lead to insect tolerance or resistance by a variety of methods. In some instances, resistance or tolerance is conferred through a secondary effect of expression of the nucleic acid (for example, expression results in the production of metabolic compounds, such as sterols, that are toxic to an insect).

In other instances, expression of the nucleic acid sequence may also result in the production of a polypeptide that is directly toxic to an insect. Such polypeptides can be expressed from any of the six open reading frames in the nucleic acids corresponding to SEQ ID NOs:3, 150, 151, 26, 31, 36, 58, 78, 94, 106, 107, 110, 112, 113, 114, 117, 123 and portions thereof. These sequences are also useful for screening databases for orthologs. It is contemplated that these orthologs will also have pesticidal activity. Insecticidal activity of potions of the insecticidal polypeptides can be determined by synthesizing the portions or expressing the portions in plants and exposing insects to plant material comprising the polypeptides. An example of such an assay is provided in Example 12C.

The polypeptides may be administered as a secretion or cellular protein originally expressed in a heterologous prokaryotic or eukaryotic host. Bacteria are typically the hosts in which proteins are expressed. Eukaryotic hosts could include but are not limited to plants, insects, and yeast. Alternatively, the toxins may be produced in bacteria or transgenic plants in the field or in the insect by a baculovirus vector. Typically insects will be exposed to toxins by incorporating one or more of the toxins into the food/diet of the insect.

Complete lethality to feeding insects is preferred, but is not required to achieve functional activity. If an insect avoids the toxin or ceases feeding, that avoidance will be useful in some applications, even if the effects are sublethal or lethality is delayed or indirect. For example, if insect resistant transgenic plants are desired, the reluctance of insects to feed on the plants is as useful as lethal toxicity to the insects since the ultimate objective is protection of insect-induced plant damage rather than insect death.

There are many other ways in which toxins can be incorporated into an insect's diet.

For example, it is possible to adulterate the larval food source with the toxic protein by spraying the food with a protein solution, as disclosed herein. Alternatively, the purified protein could be genetically engineered into an otherwise harmless bacterium, which could then be grown in culture, and either applied to the food source or allowed to reside in the soil in an area in which insect eradication was desirable. Also, the protein could be genetically engineered directly into an insect food source. For instance, the major food source for many insect larvae is plant material. Therefore the genes encoding the nucleic acid sequences described above can be transferred to plant material so that the plant material expresses the toxin of interest It is within the scope of the invention as disclosed herein that the polypeptides may be truncated and still retain functional activity. By "truncated polypeptide" is meant that a portion of a polypeptide may be cleaved and yet still exhibit activity after cleavage. Cleavage can be achieved by proteases inside or outside of the insect gut. Furthermore, effectively cleaved proteins can be produced using molecular biology techniques wherein the DNA bases encoding the toxin are removed either through digestion with restriction endonucleases or other techniques available to the skilled artisan. After truncation, the proteins can be expressed in heterologous systems such as *E. coli*, baculoviruses, plant-based viral systems, yeast and the like and then placed in insect assays as disclosed herein to determine activity

EXAMPLES

Example 1

Construction and Characterization of a Normalized *Arabidopsis* cDNA Library in GENEWARE Vectors A. Plant Tissue Generation: *Arabidopsis thaliana* ecotype Columbia (0) seeds were sown and grown on PEAT LITE MIX (Speedling Inc., Sun City, Fla.) supplemented with NUTRICOTE fertilizer (Plantco Inc., Ontario, Canada). Plants were grown under a 16-hour light/8-hour dark cycle in an environmental controlled growth chamber. The temperature was set at 22° C. for daytime and 18° C. for nighttime. The entire plant, root, leaves and all aerial parts were collected 4 weeks post sowing. Tissue was washed in deionized water and frozen in liquid nitrogen.

B. RNA Extraction: High quality total RNA is isolated using a hot borate method. All solutions were made in DEPC-treated, double-deionized water and autoclaved. All glassware, mortars, pestles, spatulas, and glass rods were baked at 400° C. for four hours. All plasticware was DEPC-treated for at least three hours and then autoclaved.

Thirty-five ml of XT buffer (0.2 M Na borate decahydrate, 30 mM EGTA, 1% SDS (w/v), 1% deoxycholate, sodium) per 10 grams of tissue was dispensed into 50 ml Falcon tubes. PVP-40,000 was added to a final concentration of 2% (w/v). NP-40 was added to a final concentration of 1% (w/v). Tubes were placed in an 80° C. water bath. The mortar and pestles were then pre-cooled in liquid nitrogen. Proteinase K (0.5 mg/ml XT buffer) was dispensed into 250 ml centrifuge bottles and the bottles were then placed on ice.

The tissue was added to the pre-chilled mortar and pestle and ground to a fine powder. Working as quickly as possible, the tissue was transferred to a glass beaker using a spatula chilled in liquid nitrogen. DTT (1.54 mg/nl XT buffer) was added to the XT buffer/PVP/NP-40 buffer and was immediately added to the ground tissue. The tissue was homogenized using a polytron at level 5 for one minute. The homogenate was decanted into the 250 ml centrifuge bottle containing the proteinase K. The homogenate was incubated at 42° C., 100 rpm for 1.5 hours. Eighty microliters of 2M KCl/ml of XT buffer was added to the homogenate and gently swirled until mixed. The samples were then incubated on ice for one hour. The samples were centrifuged at 12,000×G in a BECKMAN JA-14 rotor (Beckman Instruments, Inc., Fullerton, Calif.) for 20 minutes at 4° C. to remove debris. The supernatant was then filtered through a funnel lined with sterile miracloth into a sterile 250 ml centrifuge bottle. Eight molar LiCl was added to a final concentration of 2M LiCl and the samples were incubated on ice overnight.

Precipitated RNA was pelleted by centrifugation at 12,000×G in a BECKMAN JA-14 rotor for 20 minutes (Beckman Instruments, Inc., Fullerton, Calif.) and the supernatant was discarded. The RNA pellet was washed in 5 ml of cold 2M LiCl in 30 ml centrifuge tubes. Glass rods and gentle vortexing were used to break and disperse the RNA pellet. The pellets were centrifuged in a Beckman JA-20 rotor for 10 krpm at 4° C. for 10 minutes. The supernatant was decanted. This wash step was repeated 3 times until the supernatant was relatively colorless. The RNA pellet was resuspended in 5 ml of 10 Tris-HCl (pH 7.5). The insoluble material was pelleted in a JA-17 at 10 k rpm for 10 minutes at 4° C. The supernatant was transferred to another 30 ml centrifuge tube and 0.1× volume of 2M K-acetate (pH 5.5) was added. The samples were incubated on ice for 15 minutes and centrifuged in a BECKMAN JA-17 rotor (Beckman Instruments, Inc., Fullerton, Calif.) at 10 k rpm, 4° C., for 10 minutes to remove polysaccharides and insoluble material. The supernatant was transferred to a sterile 30 ml centrifuge tube and RNA was precipitated by adding 2.5× volumes of 100% ethanol. The RNA was precipitated overnight at −20° C. The precipitated RNA was pelleted by centrifugation at 9 krpm, 4° C. for 30 minutes in a JA-17 rotor. The RNA pellet was washed with 5 ml of cold 70% ethanol and centrifuged in a JA-17 rotor at 9 k rpm, 4° C. for 10 minutes. The residual ethanol was removed using a BECKMAN speed vac (Beckman Instruments, Inc., Fullerton, Calif.). The RNA pellet was resuspended in 3 ml of DEPC-ddH 0+1 mM EDTA. The RNA was precipitated with 0.1× volumes of 3M Na-acetate pH 6.0 and 2× volumes of cold 100% ethanol. The RNA was put at −80° C. for storage. A BECKMAN spectrophotometer (Beckman Instruments, Inc., Fullerton, Calif.) was used to measure absorbance (A) at $A_{260}$ and $A_{280}$. The $A_{260}$ was used to determine concentration (40 μg RNA/ml=1 $A_{260}$ absorbance unit) and the $A_{260}/A_{280}$ ratio was used to determine the initial quality of the RNA (1.8 to 2.0 is good).

The yield of total RNA from 60 g of tissue is ~15 mg. Then, mRNA was isolated from total RNA using oligo $(dT)_{25}$ DYNABEADS (Dynal, Inc., Lake Success, N.Y.). Typically, 1% of total RNA population can be recovered as mRNA in *Arabidopsis thaliana* whole plant and from 5 μg of poly A+ RNA, approximate 4.5 μg of single strand cDNA and 6.7 μg of double strand cDNA was synthesized.

C. cDNA Synthesis: Poly A+ RNA was purified from total RNA using the oligo (dT) DYNABEADS kit (Dynal, Inc., Lake Success, N.Y.) according to manufacturers instructions. Briefly, DYNABEADS was resuspended by mixing on a roller and transfer 600 μl to an RNase free tube. The beads were further equilibrated with 2× binding buffer (20 mM Tris-HCl, pH 7.5, 1M LiCl, 2 mM EDTA) twice and resuspended in 200 μl of 2× binding buffer. Total RNA 1 mg/200 μl) was heated at 70° C. for 5 minutes and incubated with the above oligo (dT) DYNABEADS for 10 min at RT. The supernatant containing unbound rRNA and tRNA was subsequently removed by magnetic stand and washed twice with 1× wash buffer (10 mM Tris-HCl, pH 7.5, 0.15M LiCl, 1 mM EDTA). The mRNA was eluted from the DYNABEADS in ddH$_2$O and used as the starting material for double strand cDNA synthesis.

Double strand cDNA was synthesized either with NotI-$(dT)_{25}$ primer or on oligo (dT) DYNABEADS based on the manufacturers instruction (Gibco-BRL superscript system). Typically, 5 μg of poly A+ RNA was annealed and reverse transcribed at 37° C. with SUPERSCRIPT II reverse transcriptase (Stratagene, La Jolla, Calif.). For the non-normalized cDNA library, double stranded cDNAs were ligated to a 500 to 1000-fold molar excess SalI adaptor, restriction enzyme NotI digested and size-selected by column fractionation. Those cDNAs were then cloned directionally into the XhoI-NotI sites of the TMV expression vector, 1057 N/P.

D. Normalization Procedure: For the normalized cDNA preparation, the supernatant was removed from the DYNABEADS and the cDNA containing beads were washed twice with 1×TE buffer. To carry out the normalization process, the second strand cDNA were eluted from the beads. One hundred μl of TE buffer was added to the beads and heated at 95° C. for 5 min and the supernatant was then collected on magnetic stand. The above procedure was repeated once to ensure complete elution. The yield of second strand cDNA was quantitated using a UV spectrophotometer.

First strand EDNA beads is combined with second strand cDNA in 4×SSC, 5× Denhardt's and 0.5% SDS for multiple rounds of short hybridization. Since the second strand cDNA was synthesized using the first strand cDNA as the template, approximately the same amount of first and second strand cDNAs were present in the hybridization reaction. Nine μg of second strand cDNA in 200 l of 1×TE buffer was added to the cDNA driver (first strand cDNA on beads) in a screw cap tube. The reaction was heated at 95° C. for 5 min, then 60 μl of 20×SSC, 30 μl of 50× Denhardt's (1% of Ficoll, 1% of polyvinylpyrrolidone and 1% of bovine serum albumin) and 15 μl of 10% SDS were added and the reaction was brought to 65° C. for 8 hours.

The beads and supernatant were separated at 65° C. by magnet. The supernatant was transferred to a fresh tube and kept at 65° C. The beads were regenerated by adding 200 μl of ddH$_2$O and heated at 95° C. for 5 min. We collected the beads for the next round of hybridization and kept the solution containing the bound second strand cDNA for further analysis. The partially normalized second strand cDNA solution was added back to the regenerated beads and a return to another round of hybridization of 8 hours. This procedure was repeated 4-5 times.

E. Slot blot analysis: To follow the process of cDNA normalization a rapid slot blot procedure was developed. Following sequencing of 960 cDNAs, 46 cDNAs were selected to follow the representation of various classes of cDNAs through the normalization procedure. Based on their frequency of appearance in the sequence, these clones represent transcripts of different expression levels (high, moderate and low). Ten nanograms of each cDNA were deposited onto a HYBOND-N+ membrane (Amersham Pharmacia Biotech, Chicago, Ill.) along with control vector (pBS) and water controls. DNA was denatured, neutralized, and subsequently crosslinked into the membrane using UV-STRATALINKER 2400 (Stratagene, La Jolla, Calif.).

cDNAs from either non-normalized or normalized pool were labeled with $^{32}P$ and hybridized on the slot blot membrane overnight at 65° C. in 1% bovine serum albumin, 1 mM ethylenediaminetetraacetic acid (EDTA), 0.5 M sodium phosphate (pH 7.2), and 7% sodium dodecyl sulfate (SDS). Then, blots were washed once in 1×SSC/0.2% SDS for 20 min at room temperature followed by two washes in 0.2×SSC/0.2% SDS for 20 min. at 650C. The resulting membranes were then developed using a PHOSPHORIMAGER (Amersham Pharmacia Biotech, Chicago, Ill.) and quantitated using available software.

F. Conversion of single-stranded normalized cDNAs to double-stranded form: Second strand normalized cDNA in hybridization solution was purified by QIAQUICK column (QIAGEN GmbH, Hilden, Germany) and eluted in 88 µl of ddH$_2$O (total ~1.2 µg of DNA is recovered). One µl (3 µg) of NotI-oligo dT primer was added and heated at 95° C. for 5 min followed by cool down to 37° C. The first strand cDNA was extended with T7 DNA polymerase (Amersham Pharmacia Biotech, Chicago, Ill.) in the presence of dNTP in 120 µl reaction at 37° C. for 1 hour. T4 DNA polymerase (NEB) was then used to polish the ends following the extension reaction for 5 min at 16° C. The resulting double strand cDNA was ethanol precipitated and ligated with 500- to 1000-fold molar excess of SalI adaptor followed by NotI digestion. The resulting cDNAs were size-fractionated using a Clontech spin column 400 and the first two fractions that contained the cDNAs were pooled and used for the subsequent cloning process.

G. Construction of cDNA libraries in GENEWARE vectors: (+) Sense cDNA clones were prepared as follows. The Tobacco Mosaic Virus expression vector, 1056GTN-AT9 was linearized with NotI and XhoI and a 900 bp stuffer DNA was removed. The presence of the stuffer DNA in between those two sites is to ensure the complete digestion by restriction enzymes and thus achieve the high cloning efficiency. The digested vector was gel purified and then used to set up ligation reaction with normalized cDNA SalI-NotI fragments to generate (+) sense cDNA clones.

(−) Sense cDNA clones were prepared as follows. The Tobacco Mosaic Virus expression vector 1057 NP also linearized with NotI and XhoI and a stuffer DNA fragment was removed. The digested vector was gel purified and used to set up ligation reaction to generate (−) sense strand library.

Each ligation was transformed into chemically competent *E. coli* cells, DH5 (according to manufacturer s instruction (Life Technologies, Rockville, Md.). Preliminary analysis of cloning efficiency was measured by plating of a small portion of the transformation, while archiving the majority for future applications. Vector-only ligations gave ~2×10$^4$ cfu/µg vector and ligations with cDNA insertions gave ~5×10$^5$ cfu/µg.

To support the ability to transfect plants, a TMV based vector identified as PBSG1057 was deposited under the Budapest Treaty with the ATCC. It is designated ATCC # 203951. A linker sequence 5'- CCCACGCGTCCG-3' SEQ ID NO: 572 is placed at the 5' end of each sequence for insertion into the viral vector.

H. Analysis of Normalized cDNA populations: With each successive round of kinetic re-association, the total cDNA population is depleted thereby confirming the removal of a population of the cDNA from the mixture at each step. To further understand the consequences of this depletion and measure the relative normalization in cDNA representation following various stages of the kinetic re-association method, slot blots of 46 genes of varying representations were hybridized with probes made from non-normalized and normalized cDNA preparations. The resulting blots were then analyzed for representation by PHOSPHORIMAGER analysis. The hybridization pattern of non-normalized cDNA to the gene array reveals a quite asymmetric representation with some genes hybridizing with great intensity while others showing no hybridization at all. The variance among hybridization intensities for each spot within the filter was measured by standard deviation and found to be 649. In order to analyze the cDNA fraction depleted from the mixture, the first strand magnetic bead matrix was eluted, a radioactive probe was generated and hybridized to a replica of the slot blot described above. The hybridization intensity shows that primarily cDNAs of higher copy number were bound and removed from the normalized cDNA population, confirming that the depletion phenomenon correlated with removal of primarily high copy number cDNAs. The cDNA population not bound to first strand magnetic beads after 5 serial passages was collected, radioactive probe was generated and hybridized to a replica slot blot of known gene set described above. The resulting hybridization pattern is in striking contrast to that of the non-normalized cDNA and to that of the bound cDNA fraction. Assuming that the majority of the hybridization signal to the slot blot for the non-normalized cDNA blot results from hybridization to high abundance genes, an initial comparison can be between the number of bound counts on the normalized versus non-normalized slot blots. This comparison is possible since each probe added to the blots was derived from the same quantity of cDNA material and an equal number of probe counts were applied to the blots. The non-normalized blot contained 17,898 counts while the normalized blot contained only 1494 counts. This represents a 12-fold reduction in overall signal indicating a significant reduction in high gene copy number in the normalized cDNA population.

When the hybridization intensity of the non-normalized cDNA probe to each gene is plotted against the relative number of counts (following subtraction of the pBS vector control intensity from each sample), there is almost a 4-log difference in sequence representation in the cDNA population and an overall variance in standard deviation of 649-fold. In contrast, the hybridization of normalized cDNA probe to each gene revealed a average 32-fold difference. This represents both a reduction in high copy cDNAs and an increased representation in low copy cDNAs by >3 logs. The variance between the most highly represented cDNA and lowest represented cDNA within the normalized cDNA population was ~1.5 logs. The above values characterizing the degree of library normalization are equivalent to those achieved by Soares, et al. (1994).

I. Analysis of GENEWARE clones: To ascertain the cloning efficiency of normalized cDNA into each vector and the average insert size, 96 random colonies were picked and grown by standard methods. DNA was isolated from bacteria using a BIOROBOT 9600 (QIAGEN GmbH, Hilden, Germany). DNA was digested with Not I and BsiWI restriction endonucleases (recognition sites flank the cDNA insertion). The digestions were separated on agarose gels and visualized by ethidium bromide staining. The digestions revealed a vector religation background of 4%. Ligations giving >75% insertions were passed as to quality control and more colonies were picked. Approximately 600 independent clones were analyzed by restriction digestion as described above. Interestingly, a similar percentage of vector background was detected 4% and the average insert size in the vector was ~1 kb, with many inserts with 2 kb or greater sized inserts. Following analysis of DNA by restriction mapping, DNA was subjected to sequencing and further analysis.

J. Sequence Analysis of the Normalized *Arabidopsis* Library in GENEWARE Initial analysis of non-normalized *Arabidopsis* cDNA library required the sequencing of 1709 independent clones. Three 96-well plates (SeqID # 56601-56896) of randomly picked normalized *Arabidopsis* library in GENEWARE [(−) sense] were initially sequenced by primer TP6 to yield 262 5' sequences and passed sequence quality control. Initially, internal cluster analysis was performed to identify identical sequences in this sequence subset. Analysis using BLASTN algorithm showed that of the 262 sequences analyzed, 252 were unique and only 10 were found to cluster into five two-member clusters. We then identified the redundancy of the sequences against the larger public databases. For cluster analysis, we used a very low BLASTX score criteria (e=$10^{-6}$) and compared all sequences against the GENBANK nr database United States Department of Health and Human Services). In this manner, we could derive the most information concerning the redundancy, gene type found and open reading frame status of all clones simultaneously. The low BLASTX score was used to allow all possible protein homologues to be identified. The clustering analysis revealed that of the 262 sequences there were 252 single member sequence clusters and five two-gene clusters. This represents 96% singletons from this sample size. The genes appearing more than once in the library varied from two different chlorophyll a/b binding proteins, lipid transport proteins to ferrodoxin-thioredoxin reductases. This result compares quite favorably to the 4 redundant clones (of one gene type) identified by Soares, et al. (1994) from 187 randomly picked clones from one normalized library.

Further analysis of the sequences from the GENEWARE normalized cDNA library revealed that of the 262 sequences subjected to BLASTX search of the GENBANK nr database, 29% of the sequences failed to show significant homology to any characterized protein or open reading frame (ORF). Of the 252 singletons in the library, 179 showed single hit to an identified ORF, while 73 showed no hit. These results suggest that, in spite of the well-characterized nature of the sequence database quality libraries can still contain a high proportion of new expressed sequences.

The excellent representation and extremely low redundancy observed in these initial plates of normalized *Arabidopsis* cDNAs in GENEWARE prompted us to sequence additional clones. This was important because there is often a significant bias in small sample sizes with regard to representation. A total of 1,151 sequences passed sequence quality control. Internal cluster analysis showed that ~260 multi-sequence clusters were present, with the highest representation at 6 members and the majority with only 2 members (~150). About 600 unique clusters were identified from the total of 856 clusters from the 1151 sequences. Therefore, from the 1151 sequences analyzed, 1,010 unique genes were identified, or a 87.7% gene discovery rate. In contrast, internal cluster analysis of the non-normalized *Arabidopsis* cDNA sequences revealed ~840 multi-gene clusters with the highest represented cluster containing 27 members. Cluster analysis of the 1709 non-normalized *Arabidopsis* cDNAs revealed clusters of 27 members and many other highly populated clusters. The dramatic difference in the normalized population is clearly observed by plotting cluster number versus number of members.

Further comparison of 1,151 randomly chosen non-normalized sequences for redundancy with the results from the 1,151 normalized population clearly shows the positive effects of normalization and the greater number of unique genes identified from this normalized population. The reduction in the representation of individual genes in the normalized library compared with the non-normalized population can be observed. Clearly, many genes that have representations of >12 in the non-normalized library have been reduced to 1-4 members in the normalized population. One chlorophyll a/b binding protein gene shows a reduction from 15 members in the non-normalized population to 1 in the normalized library, whereas a gene encoding a distinct chlorophyll a/b binding protein shows less reduction (7 as compared with 5) in the normalized gene population. This is consistent with the observation that certain genes did not undergo the same degree of normalization compared with other genes.

Additional sequences from the normalized *Arabidopsis* library were obtained by sequence analysis. BLASTN analysis of the 1,343 normalized sequences revealed that 858 were represented in the *Arabidopsis* EST database, while the remaining 485 sequences were apparently unique, with no obvious homologue in the database. Of those sequences showing BLASTN hits, 43.6% showed coverage of the first through tenth base in the longest EST in the database. Furthermore, 242 of the 858 (28%) showed 5 sequences that were at the first base of the longest EST or longer. These data show that the cDNAs cloned into GENEWARE are of significant quality and represent, in many cases, the longest 5 sequences obtained to date. To further ascertain the proportion of cDNAs containing full-length protein open reading frames, we employed the ORF finder program used to analyze the ABRC library for sense clones. This algorithm checks for ATG sequences in the first 70 bases of a sequence and then scans for sequences lacking an in-frame stop codon for at least 300 nt downstream in the same frame. To understand the number of quality open reading frames (ORFs) in a library, we used the ABRC library as a benchmark. Analysis of 11,957 sequences within the ABRC library with the ORF finder program revealed 3,207 hits (26.8%) with putative open reading frames. From the 1,343 sequences of the normalized *Arabidopsis* cDNA library in GENEWARE, 907 (67.5%) were hits using the ORF finder program. Coupling the number of cDNAs that represent near the 5' end of the known RNA sequence (43.6%) with the number of clones that contain putative intact OREs (67.5%) testifies to the quality and integrity of the cDNAs in the GENEWARE vector. These data clearly indicate a high proportion of full-length clones.

K. Quantity of Normalized *Arabidopsis* cDNAs Cloned into GENEWARE Vectors: As previously described, the normalized *Arabidopsis* cDNA population was cloned into GENEWARE(vectors in both the positive (+) and negative (−) sense direction to allow for both over expression and gene knockout analysis. The total number of clones in the 1057 PN vector in negative orientation was 20,160. These were arrayed into 210 96-well glycerol stock plates. Likewise, 20,160 clones from the ligation of normalized *Arabidopsis* cDNA in sense orientation into 1056 GTN vector have been arrayed in 210 96-well glycerol stock plates. These numbers clearly show that the GENEWARE vectors can be used as primary cloning vectors and that very complex libraries can be obtained in two orientations from a single pool on non-amplified normalized cDNA.

Example 2

Construction of Tissue-specific *N. benthamiana* cDNA Libraries

A. mRNA Isolation: Leaf, root, flower, meristem, and pathogen-challenged leaf cDNA libraries were constructed. Total RNA samples from 10-5 μg of the above tissues were isolated by TRIZOL reagent (Life Technologies, Rockville, Md.). The typical yield of total RNA was 1 mg PolyA$^+$RNA was purified from total RNA by DYNABEADS oligo (T)$_{25}$. Purified mRNA was quantified by UV absorbance at OD$_{260}$ The typical yield of mRNA was 2% of total RNA. The purity was also determined by the ratio of $OD_{260}/OD_{250}$. The integrity of the samples had OD values of 1.8-2.0.

B. cDNA Synthesis: cDNA was synthesized from mRNA using the SUPERSCRIPT plasmid system (Life Technologies, Rockville, Md.) with cloning sites of NotI at the 3' end and SalI at the 5' end. After fractionation through a gel column to eliminate adapter fragments and short sequences, cDNA was cloned into both GENEWARE vector p1057 NP and phagemid vector PSPORT in the multiple cloning region between Not1 and Xho1 sites. Over 20,000 recombinants were obtained for all of the tissue-specific libraries.

C. Library Analysis: The quality of the libraries was evaluated by checking the insert size and percentage from representative 24 clones. Overall, the average insert size was above 1 kb, and the recombinant percentage was >95%.

Example 3

Construction of Normalized *N. benthamiana* cDNA Library in GENEWARE Vectors

A. cDNA synthesis. A pooled RNA source from the tissues described above was used to construct a normalized cDNA library. Total RNA samples were pooled in equal amounts first, then polyA$^+$RNA was isolated by DYNABEADS oligo $(dT)_{25}$. The first strand cDNA was synthesized by the Smart III system (Clontech, Palo Alto, Calif.). During the synthesis, adapter sequences with Sfi1a and Sfi1b sites were introduced by the polyA priming at the 3' end, and 5' end by the template switch mechanism (Clontech, Palo Alto, Calif.). Eight μg first strand cDNA was synthesized from 24 μg mRNA. The yield and size were determined by UV absorbance and agarose gel electrophoresis.

B. Construction of Genomic DNA driver. Genomic DNA driver was constructed by immobilizing biotinylated DNA fragments onto streptavidin-coated magnetic beads. Fifty μg genomic DNA was digested by EcoR1 and BamH1 followed by fill-in reaction using biotin-21-dUTP. The biotinylated fragments were denatured by boiling and immobilized onto DYNABEADS by the conjugation of streptavidin and biotin.

C. Normalization Procedure. Six μg of the first strand cDNA was hybridized to 1 μg of genomic DNA driver in 100 μl of hybridization buffer (6×SSC, 0.1% SDS, 1× Denhardt's buffer) for 48 hours at 65° C. with constant rotation. After hybridization, the cDNA bound on genomic DNA beads was washed 3 times by 20 μl 1×SSC/0.1% SDS at 65° C. for 15 min and one time by 0.1×SSC at room temperature. The cDNA bound to the beads was then eluted in 10 μl of fresh-made 0.1N NaOH from the beads and purified by using a QIAGEN DNA purification column (QIAGEN GmbH, Hilden, Germany), which yielded 10 ng of normalized cDNA fragments. The normalized first strand cDNA was converted to double strand cDNA in 4 cycles of PCR with Smart primers annealed to the 3' and 5' end adapter sequences.

D. Evaluation of normalization efficiency. Ninety-six non-redundant cDNA clones selected from a randomly sequenced pool of 500 clones of a previously constructed whole seedling library were used to construct a nylon array. One hundred ng of the normalized cDNA fragments vs. the non-normalized fragments were radioactively labeled by $^{32}P$ and hybridized to DNA array nylon filters. The hybridization images and intensity data were acquired by a PHOSPHORIMAGER (Amersham Pharmacia Biotech, Chicago, Ill.). Since the 96 clones on the nylon arrays represent different abundance classes of genes, the variance of hybridization intensity among these genes on the filter were measured by standard deviation before and after normalization. Our result indicated that by using this type of normalization approach, we could achieve a 1000-fold reduction in variance among this set of genes.

E. Cloning of normalized cDNA into GENEWARE vector. The normalized cDNA fragments were digested by Sfi1 endonuclease, which recognizes 8-bp sites with variable sequences in the middle 4 nucleotides. After size fractionation, the cDNA was ligated into GENEWARE vector p1057 NP in antisense orientation and transformed into DH5α cells. Over 50,000 recombinants were obtained for this normalized library. The percentage of insert and size were evaluated by Sfi digestion of randomly picked 96 clones followed by electrophoresis on 1% of agarose gel. The average insert size was 1.5 kb, and the percentage of insert was 98% with vector only insertions of >2%.

F. Sequence analysis of normalized cDNA library. Two plates of 96 randomly picked clones have been sequenced from the 5' end of cDNA inserts. One hundred ninety-two quality sequences were obtained after trimming of vector sequences and other standard quality checking and filtering procedure, and subjected to BLASTX search in DNA and protein databases. Over 40% of these sequences had no hit in the databases. Clustering analysis was conducted based on accession numbers of BLASTX matches among the 112 sequences that had hits in the databases. Only three genes (tumor-related protein, citrin, and rubit) appeared twice. All other members in this group appeared only once. This was a strong indication that this library is well-normalized. Sequence analysis also revealed that 68% of these 192 sequences had putative open reading frames using the ORF finder program (as described above), indicating possible full-length cDNA.

Example 4

DNA Preparation

A. High Throughput Clone Preparation: Arraying of the ABRC library into GENEWARE vectors was conducted to obtain ~5,000 antisense and ~3,000 sense clones with minimal redundancy. The ligations were between highly purified and quality controlled GENEWARE cloning vector plasmids and the corresponding fragments from each individual pool of ABRC clones. Cloning efficiencies were in the range of $1\times10^5$ to $5\times10^5$ per μg of plasmid. Colonies were picked using a Flexys Colony Picker (The Sanger Centre, England) and manual methods. Colonies were applied to deep-well cell growth blocks (DWBs) and grown from 18-26 hours at 37° C. at ~500 rpm in the presence of ampicillin concentrations of 500 μg/ml. From the almost 9,000 colonies picked by the Flexys, >97% of the cultures successfully grew. DNA was prepared using the QIAGEN BIOROBOT 9600 DNA robots and QIAGEN 96-well manifolds (manual preparation) at a rate of ~2,000 DNA preparations per day. The final throughput, during campaign production, estimated for each system was ~20 plates of 96 samples per day, per production line—robotic or manual. Such throughput could be sustained to generate 20-40,000 samples in a matter of one to two weeks of effort. During one ten day period, one hundred four (140) 96-well plates of DNA were produced.

B. Quality Control Methods: DNA samples were subjected to quality control (QC) analysis by at least one of two methods: 1) restriction endonuclease digestion and analysis by agarose gel electrophoresis (all plates) or 2) UV spectroscopy to determine DNA quantitation for all 96 samples of a plate (statistical sampling of each days output). For UV analysis, an aliquot of the DNA samples from each plate was taken and measured using a Molecular Dynamics UV spectrometer in 96-well format (Molecular Dynamics, Sunnyvale, Calif.). DNA concentrations of 0.05-0.2 (µg/µl) with OD 260/280 ratios of 1.7±0.2 are expected. For DNA sequencing purposes (a downstream method to be used to analyze all hit samples), DNA quantity of ~0.04-0.2 µg/µl is desired. In general, plates that contain >25% of samples not conforming to this metric are rejected and new DNA for the plate must be generated once again. For conformation of the presence of insertions and full-length GENEWARE vector, agarose gel electrophoresis of restriction endonuclease fragments was used. Aliquots of sixteen samples from each 96-well DNA plate were targeted for restriction digestion using Nco I and BstE II restriction endonucleases. Samples were separated on 1% agarose gels. Generally, plates that showed >25% of samples that were not full length or did not contain insertions were rejected. From a total of 140 96-well DNA plates prepared, 112 passed QC and were made available for generation of infectious units.

Example 5

High-Throughput DNA Sequencing and Sequence Analysis Protocols

A. Generation of Raw Sequence Data and Filtering Protocols: High-throughput sequencing was carried out using the PCT200 and TETRAD PCR machines (MJ Research, Watertown, Mass.) in 96-well plate format in combination with two ABI 377 automated DNA sequencers (PE Corporation, Norwalk, Conn.). The throughput at present is six 96-well plates per day.

The quality of sequence data is improved by filtering the raw sequence output from sequencer. One criteria is to make sure that the unreadable bases are less than 10% of the total number of bases for any sequence and that there are no more than ten consecutive Ns in the middle part of the sequence (40-450). The sequences that pass these tests are defined as being of high quality.

The second step for improving the quality of a sequence is to remove the vectors from the sequence. There are two advantages of this process. First, when locating the vector sequence, its position can be used to align to the input sequence. The quality of the sequence can be evaluated by the alignment between the vector sequence and the target sequence. Second, the removal of the vector sequence greatly improves the signal-to-noise ratio and makes the analysis of the resulting database search much easier. A third important prefiltering step is to eliminate the duplicates in a library so it will speed up the analysis and reduce redundant analyses.

B. Sequence Data Analysis and Bioinformatics: Once the filtering and the vector sequence removal steps are completed, the resulting sequences are subjected to database search. First, low sensitivity methods such as BLASTN and BLASTX can be used. For those sequences that have no hit, more sensitive methods, such as Blimps and Pfam can be used. To speed up the analysis process, appropriate filters may be used. For example, for EST sequences from a given cDNA library sequenced from the 5' end, an ATG filter can be used to make sure that only full-length cDNA will be analyzed. The filtered sequence can be translated in one frame rather than six frames for Pfam analysis.

The results from the database search are stored in the relational database and can be used for further analysis. For example, all the BLAST results can be stored in a relational table that contains Query, Score, pValue, Hit, Length, Annotation, Frame, Identity, Homology, Query Length, Subject Length, Database Queried and Method used to analyze. Any result can be queried and analyzed by the fields mentioned. A database link between the analysis result database and the laboratory information management system (LIMS) will be created so that the analysis result can be related to the experimental data.

C. Metabolic Pathway Analysis: Many metabolic pathway databases have been constructed that group proteins based on their roles in a metabolic pathway. The basic identifiers for these proteins are E.C. numbers; therefore, the position of a given enzyme in a metabolic pathway may be determined based on its E.C. number. By querying the GENETHESAURUS database (DoubleTwist, Inc., Oakland, Calif.), the E.C. number of a protein can be obtained by its GenBank ID. This approach can be used to assign the corresponding E.C. number to the hits found for each cDNA sequence. By querying the metabolic pathway using the E.C. number of a hit, a potential link between this cDNA sequence and the metabolic pathway may be established. Each link can be used as a building block for a plant metabolic pathway. This potential link between cDNA sequence and metabolic pathway provides a starting point to analyze the gene s role in a metabolic pathway.

D. Sequence Analysis of Library Created from GENEWARE Vectors: Five hundred sixty-eight (568) independent clones were sequenced from the virus expression library and the clones from this library were analyzed by vector, N filters and BLAST analysis. Of the 568 initial sequences submitted for analysis, 131 were eliminated by the N-filter indicating that ~15% of the sequence were undetermined Ns. The remaining 437 sequences were then subjected to analysis for duplication within each set of submitted plates. Fifty-five (55) sequences were removed due to this duplication filter. These sequences were BLASTN searched against 539 sequences from the AtwpLNLH library in Lambda Zap II. Thirty percent (30%) of the sequences (132 sequences) found a match in both libraries. From the original set of GENEWARE clones, 305 were found to be unique with respect to the Lambda Zap II library. These sequences were then BLASTX-searched against non-redundant GENBANK. From the 305 submitted sequences, 173 sequences found solid hits in protein coding sequence as determined by hit criteria and 132 were found to be unique. Further BLASTN analysis showed a range of sequence homology, but many represented hits to BAC or chromosomal sequences. A wide range of sequences were found including, ribosomal proteins, photosystem reaction center proteins, fumarase and other general metabolism proteins, transcription factors, kinase homologs, omega-6 fatty acid desaturase and various hypothetical proteins. These results strongly suggest that little or no bias is introduced during the construction of cDNA libraries in GENEWARE.

Example 6

Preparation of Infectious Units

DNA plates that pass QC testing were then moved to the next stage of the cycle, the generation of infectious units. In vitro RNA transcriptions have been optimized to produce maximal amounts of RNA in smaller volumes to reduce costs and increase the lifetime of a DNA preparation. A transcription mixture containing a 6-to-1 RNA cap structure-to-rGTP ratio, Ambion mMessage Machine buffer and enzyme mix (Ambion, Inc., Austin, Tex.) is delivered to a 96-well plate by the TECAN liquid handling robot (TECAN, Research Triangle Park, N.C.). To this reaction mix, the Robbins Scientific HYDRA 96-sample pipeting robot (Robbins Scientific, Sunnyvale, Calif.) delivers 2 μl of DNA solution. This final transcription reaction is incubated at 37° C. for 1.5 hours. Following incubation, the TECAN robot delivers 95 μl of a 100 mM Na/K $PO_4$ buffer containing TMV coat protein (devoid of all infectious RNA) to the transcription plate and it is incubated overnight. This incubation generates encapsidated transcripts, which are very stable at room temperature or 4° C. and amplified with regard to number of infectious units per (g of RNA transcript. The generation of infectious materials is measured by inoculation of GFP-expressing virus to systemic host or *Nicotiana tabacum* NN lines, incubation at permissive temperatures and counting of developing local lesions on inoculated leaves. Before addition of the TMV coat protein mixture, 0.5 μl from 8 wells of each transcription plate is removed and analyzed by agarose gel electrophoresis. The presence of an RNA band of ~1.6 to 3.5 kb is strong evidence for a successful transcription. If >25% contain only lower molecular weight RNA bands, or if the band is diffuse <500 bp of dsDNA marker, the transcription plate is considered to have failed and removed from the stream of plates prepared for inoculation. During a two-week period, 112 plates were transcribed and 108 plates were passed for plant inoculation in growth rooms and in the field.

Example 7

Plant Inoculation with Encapsidated RNA Transcripts

In order to prepare for plant inoculation, 90 μl of each encapsidated RNA transcript sample and 90 μl of FES transcript inoculation buffer (0.1M glycine, 0.06 M $K_2HPO_4$, 1% sodium pyrophosphate, 1% diatomaceous earth and 1% silicon carbide) were combined in the wells of a new 96-well plate. The 96 well plate was then placed on ice. *Nicotiana benthamiana* plants 14 days post sowing were removed from the greenhouse and brought into the laboratory. Humidity domes were placed over the plants to retain moisture. The RNA transcript sample was mixed by pipetting the solution prior to application to ensure that the silicon carbide and the diatomaceous earth were resuspended. The entire sample, 180 μl, was drawn up and pipetted in equal aliquots (approximately 30 μl), onto the first two true leaves of three separate *Nicotiana benthamiana* plants. The mixture was spread across the leaf surface using a TEXWIPE CLEANFOAM swab (The Texwipe Co, Upper Saddle River, N.J.). The wiping action caused by the swab together with the silicon carbide in the buffer sufficiently abrades the leaves so as to allow the encapsidated RNA transcript to enter the plant cell structure. Other methods used for inoculation have included pipetting of encapsidation-FES mixture onto leaves and rubbing by hand, cotton swab or nylon inoculation wand. Alternatively, nylon inoculation wands may be incubated in the transcript-FES mixture for ~30 min to soak up ~15 l and then rubbed directly onto the leaves.

Once an entire 32 plant flat was inoculated, the plants were misted with deionized water and the humidity domes were replaced over them. The inoculated plants were retained in the laboratory for 6 hours and then returned to the greenhouse. Once in the greenhouse, the humidity domes were removed and the plants were misted a second time with deionized water.

Example 8

Inoculated Plant Growth

Plants inoculated with encapsidated virus were grown in a greenhouse. Day length was set to 16 hours and shade curtains (33% transmittance) were used to reduce solar intensity. Whenever ambient light fell below 250 μmol $m^2s^{-1}$, a 50:50 mixture of metal halide and sodium halide lamps (Sylvania), delivering an irradiance of approximately 250 μmol $m^2s^{-1}$, were used to provide supplemental lighting. Evaporative cooling and steam heat were used to regulate temperature, with a daytime set point of 27° C. and a nighttime set point of 22° C. The plants were irrigated with Hogland's fertilizer mix as required. Drainage water was collected and treated with 0.5% sodium hypochlorite for 10 minutes before discharging into the municipal sewer.

To allow space for increased plant size, the inoculated *N. benthamiana* were repositioned at seven days post-inoculation (dpi) so that they occupied twice their original area. At 13 dpi, the plants were examined visually for symptoms of TMV infection and were assigned a numerical score to indicate the extent of viral infection (0=no infection, 1=possible infection, 2=limited/late infection, 3=typical infection, 4=severe infection). At the same time, the plants were assigned a fate for harvest (typically the highest quality plant in each triplicate was assigned to metabolic screens and the second highest quality plant was assigned to focused screens). In cases where plant symptoms deviated substantially from those of plants inoculated with control vectors, a description of plant phenotype was recorded (see below). At 14 dpi infected plants were harvested.

Example 9

Infectivity Analysis

The method to measure the infectivity of the transcript encapsidations was to inoculate a set of 96-well plates from both positive and negative sense clones and look for systemic virus movement and phenotype development. Of the 8,352 plants inoculated with unique encapsidated transcriptions, 6,266 became systemically infected for an infection rate of 76%. Overall, the majority of plates generated showed very good infection rates. As shown in a graph of the number of systemically infectious constructs per each individual plate plotted against plate number. The majority of plates had systemic rates >70% with one at 100%. Approximately 25 plates had infection rates ranging between 40 and 70% while only 6% (>5 plates) showed infection rates <45%.

A population of constructs did not show systemic infection on *Nicotiana benthamiana* plants. Analysis using the LIMS revealed a substantial correlation between a subset of inoculators and the transcription plates showing poor infection rates. These results strongly suggest that inoculation technique is critical for good infectivity although other possible causes could include poor DNA or transcription quality, or simply inoculation error. In some cases the constructs may be restricted to inoculated leaves by way of adverse influence of the gene insertion on virus replication and movement. For example, one observed healthy inoculated *Nicotiana benthamiana* plant exhibited clear chlorotic spots on inoculated leaves, yet no systemic symptoms. Other plants, not scored as infected in our LIMS, were observed to have subliminal infections in source tissues. It was clear that the properties of the genetic insertion had differing effects on virus phenotypic symptoms. Eighty-two of those constructs exhibiting poor systemic infection were re-inoculated into *Nicotiana tabacum* NN plants to test for local lesions. The presence of local lesions indicated infectious viral vectors. From this data, a statistical calculation can be made to determine the percentage of non-systemic infective constructs that are locally infectious. Plants were scored 6 days post-inoculation for the presence of localized necrotic lesions resulting from infection and localized movement of virus vectors on the inoculated leaves of the plants. Of the 82 constructs analyzed, 50 showed local lesions indicating the presence of infectious viral vectors. Based on the infection rate observed in *Nicotiana benthamiana* and NN tobacco plants, we estimate that 1,181 (~61%) of the constructs not showing systemic infection on *Nicotiana benthamiana* plants were still infectious and amenable to biochemical analysis.

Example 10

Phenotypic Evaluation

At 13, dpi a visual examination was made to identify plants whose phenotype deviates substantially from plants infected with a GENEWARE control. The phenotypically different plants were divided into regions (for example: shoot apical region, infected phloem source leaves, stem) and descriptive terms were applied to each region to document the visual observation. Additionally, a confirmation was made as to whether or not the operator considered the plant to be a hit and a numerical score was applied to document the phytotoxic/herbicide effect of the RNA insert (1=possible effect, 2=mild, 3=moderate, 4=severe).

A matrix-style phenotypic database was created using the LIMS software. The LIMS software allows all descriptive terms to be used for any major part of the plant and the capacity of sub-parts to be described. Notable phenotypic events are captured by description of individual plant parts. The matrix is configured in a Web-based page that allows one to score infection and phenotyping using a graphic replicated of the physical arrangement of plants in the growth room. This approach is rapid, allowing 96 plants to be described in detail as being infected, not infected with a detailed phenotype in 15 min. Editing of output files can occur rapidly in MS Excel if desired. The output file is then loaded as CSV files into the LIMS where it is immediately available to Boolean query as to phenotype descriptors with "and, or, not" statements. Images of infected plants are linked to the SeqIDs in the database so that the plant tray bar code (for infection), well position, SeqID, phenotype and picture all link together when a query is made. This is linked back to the sequence database for sequence annotation data. Using this system, 8,352 phenotypic observations were made in the period of two days and entered into the LIMS. Hundreds of interesting visual phenotypes were observed.

One measured phenotype was stunting of plant growth. Plants infected with viral vectors comprising SEQ ID NOs: 1-154 exhibited a stunting phenotype in the initial assay.

Example 11

Field-Scale Genomics

The effects of gene over expression and gene silencing in plants may have dramatic differences when grown under different conditions. The Kentucky field test plots available to Large Scale Biology, Inc. provides an opportunity to subject plants to substantially different growth conditions and thereby broaden the chances of detecting various types of hits in a genomics screen. To compare the ability of virus vectors to be applied under field conditions and under controlled growth room conditions, we inoculated, in duplicate, 960 positive-sense constructs on *Nicotiana benthamiana* plants grown in the field test plot in Owensboro, Kentucky. This activity was concurrent with inoculations and screens performed in Vacaville, Calif. Complete encapsidated transcription reactions were prepared at Biosource Genomics in Vacaville, Calif. and following incubation with TMV coat protein, FES buffer was added to each well. All samples in column 12 of each plate contained encapsidated transcripts of 1057 vector containing the GFP gene. The mixture was then overnight-mailed to Owensboro, Kentucky where it was inoculated onto 4-5 week post-sowing plants by rubbing cotton swabs, pre-wetted by incubation with encapsidated transcript-FES mixture, on plant leaves. Plants were inoculated in duplicate. Plants were allowed to remain in the field for 4 weeks post-inoculation and then subjected to phenotypic analysis. Photographic documentation of the plants both pre- and post-inoculation was prepared. Plants were scored by visual evaluation as to number of infected plants compared with total number of plants inoculated. Of the 1920 plants inoculated, 1,712 (88%) showed systemic infections. More than 100 new phenotypes were noted in the field. Each was compared with the phenotype of the same construct inoculated into plants in Vacaville, Calif. growth rooms. Two new phenotypes are particularly noteworthy: two independent plants showed survival phenotypes under anaerobic conditions, whereas all neighbors had succumbed to root rot in a low spot in the field.

In order to evaluate the effect of gene silencing in *Nicotiana tabacum* plants, mRNA from *Arabidopsis thaliana* whole plants was subjected to fragment normalization such that small cDNA fragments were produced. The cDNA population showed high degree of normalization by hybridizations with known genes of variable expression and by comparison with non-normalized cDNA fragments. The average size of the normalized fragments in the GENEWARE vectors was between 400-500 bp allowing facile movement of the recombinant viruses systemically in field *Nicotiana tabacum* c.v. MD609 plants. A total of 11 plates of DNA constructs (1056) were prepared, transcribed and encapsidated with GFP constructs integrated at every 12th position. These were mixed with FES and overnight-mailed to Owensboro, Kentucky. These 1056 constructs were inoculated in duplicate (2112 total) on MD609 tobacco plants 11 weeks post-sowing. One set of the replicates (1056 plants) were scored by visual evaluation as to number of infected plants compared with total number of plants inoculated. Of the 1056 plants inoculated, 808 showed systemic infections, or 76.5% infection rate. Hits were determined by unusual visual symptoms and corresponding constructs will be characterized by DNA sequencing.

An uncharacterized GENEWARE library comprised of ~20,000 *Arabidopsis thaliana* normalized fragment cDNAs and ~10,000 of *Nicotiana benthamiana* genomic DNA fragments was prepared and sprayed as a population on *Nicotiana tabacum* c.v. MD609 plants. The *Arabidopsis* cDNA library, 10,000, was constructed by ligation into prepared GENEWARE vectors and purified from pooled bacterial transformants and followed by pooled transcription. The remaining 10,000 cDNA fragments were individual clones prepared and transcribed independently and then mixed in a pooled encapsidation. The *Nicotiana* library was a prototype cell-free cloning library from restriction endonuclease fragmented gDNA of <500 bp in size. The number of clones corresponds to an approximation of the amount of DNA undergoing complete ligation. Transcriptions from each non-encapsidated library were inoculated separately into *Nicotiana tabacum* protoplasts and allowed to incubate for three days. Cells were lysed and libraries combined. The pool of cell lysates and encapsidated transcriptions containing viral libraries were shipped to Owensboro, Kentucky where they were inoculated onto *Nicotiana tabacum* c.v. MD609 plants at 1, 1/10, 1/100 and 1/000 dilution of the mixed virion preparation (using 60 ml, 6 ml, 0.6 ml and 0.06 ml of the library respectively). Eight hundred (800) plants were spray-inoculated with each library virion dilution. Plants were visually scored and of the 3,200 plants inoculated, 1,304 showed visual symptoms 3 weeks post-infection. The infectivity rate varied from ~60% for the most concentrated inoculum to ~20% for the most dilute as would be expected due to dilution. Analysis will continue to define Hits by unusual visual symptoms and PCR amplification and DNA sequencing will characterize corresponding construct.

Example 12

Metabolic Screens

A. Harvest and Preparation of Tissues for Metabolic Screening. Fourteen dpi infected plants to be harvested were moved from the greenhouse to the laboratory. Plants were scanned and identified by a bar-code that linked the infected plant to the tissue sample. The infected tissue was cut off of the plant and placed in a corresponding centrifuge tube. A tungsten carbide ball was placed on top of the infected tissue sample. The tungsten carbide ball facilitates pulverization of plant tissue. The tubes and sample were stored on dry ice during the harvesting procedure. The samples were then stored at 700C. Before conducting a metabolic screen, the tissue samples must be pulverized. The sample tubes were loaded into a KLECO pulverizer and pulverized to create a fine powder of the tissue sample. The tissue sample powder was then weighed out into a metabolic extraction vial.

B. FAME Analysis Procedure for FAME Screen. *Nicotiana benthamiana* plants expressing genes of interest in RNA vectors were grown for 14 dpi as described above. Three leaf disks (0.5 cm in diameter) were placed in cell wells of a borosilicate 96-deepwell plate (Zinsser). 500 µl of heptane was added to each well using a Biomek 2000 Laboratory Automation Workstation. The heptane/tissue samples were stirred on a Bodine magnetic stirrer. After 30 minutes, 50 µl of 0.5N sodium methoxide in methanol was added to each well using the Biomek 2000. After 30 minutes of stirring, 10 µl of water was added to each well. Injections were made directly from the 96-deepwell plate into a Hewlett Packard gas chromatograph (GC) using a LEAP auto injector. The GC method involved a 2 µl injection into a split/splitless injection port using a DB 23 narrow bore column (15 M, 0.25 I.D.). The oven temperature was isothermic at 1700C. The injector temperature was 230° C. and the detector (flame ionization) temperature was 240° C. The run time was 5 minutes, with an equilibration time of 0.5 minutes. The split ratio was 20:1 and the helium flow rate was held at a constant pressure of 19 psi. This GC method allowed for separation and quantification of fatty acid methyl esters which included C16:0, C16: 1, Cl 8:0, Cl 8: 1, C18:2, and C18:3. Using a dual column GC, four 96-well plates could be sampled in less than 24 hours.

The following sequences exhibited a positive FAME result (had altered levels of the fatty acids assayed): SEQ ID NOs: 151, 52, and 94. The result of the FAME analysis for SEQ ID NO:94 is shown in Table 4. Table 7 shows the relative percent amounts of fatty acids found in plants transfected with a viral vector comprising SEQ ID NO: 94. An increase in 16:0 fatty acids was observed in 3 of the 5 samples assayed. Table 8 shows the relative percent amounts of fatty acids found in plants transfected with SEQ ID NOs: 52 and 151.

TABLE 7

| | FAME Profile | | | | | | | | | |
|---|---|---|---|---|---|---|---|---|---|---|
| Sample | 16:0 | 16:1 | unk | 16:3 | unk | 18:0 | 18:1 | 18:2 | 18:3 | unk |
| 1 | 24.7 | 3.4 | 1.1 | 3.2 | 2.6 | 2.6 | 3.3 | 9.2 | 47.8 | 2.0 |
| 2 | 20.1 | 2.9 | 0.8 | 4.6 | 2.9 | 3.5 | 7.1 | 9.2 | 46.7 | 2.3 |
| 3 | 17.6 | 1.8 | 1.0 | 3.5 | 2.9 | 2.2 | 6.0 | 11.8 | 50.4 | 2.7 |
| 4 | 23.3 | 1.9 | 1.0 | 3.1 | 4.6 | 3.8 | 8.9 | 10.6 | 37.6 | 5.3 |
| 5 | 23.0 | 2.6 | 0.7 | 3.5 | 1.6 | 2.3 | 3.8 | 8.1 | 52.9 | 1.6 |
| control | 19.6 | 2.8 | 1.1 | 3.3 | 1.8 | 1.8 | 3.1 | 12.0 | 53.6 | 1.0 |
| control | 18.4 | 2.7 | 1.1 | 3.3 | 1.7 | 1.7 | 3.1 | 11.3 | 55.4 | 1.3 |

TABLE 8

| | FAME Profile | | | | | | | | | |
|---|---|---|---|---|---|---|---|---|---|---|
| Sample | 16:0 | 16:1 | unk | 16:3 | unk | 18:0 | 18:1 | 18:2 | 18:3 | unk |
| SEQ ID NO: 52 | 23.0 | 3.5 | 1.9 | 2.6 | 1.7 | 2 | 3.3 | 11.7 | 49.1 | 1.3 |
| SEQ ID NO: 151 | 25.7 | 3.4 | 1.3 | 1.8 | 0.8 | 2.3 | 2.1 | 8 | 54.7 | 0 |
| control | 18.7 | 2.8 | 1.2 | 3.8 | 1.4 | 1.5 | 4.2 | 10.7 | 55 | 0.6 |

C. Insect Control Bioassays. *Nicotiana benthamiana* plants expressing genes of interest in RNA viral vectors were grown for 14 dpi as described previously. Fresh leaf tissue (sample size ~2.5 cm diameter) was excised from the base of infected leaves using a scalpel and placed in insect-rearing tray (Bio RT32, C-D International) wells containing 3 ml of 2% agar. Using a small paintbrush to handle insects, 2 first-instar larvae of tobacco hornworm (*Manduca sexta*) were placed in each well and trays were sealed using vented covers. Trays were then incubated at 28 C with 4S% humidity for 72 hours with a 12-hour photoperiod. Following incubation, samples were scored for mortality and leaf damage according to the following criteria: mortality, 0=0 dead/2 alive; 1=1 dead/1 alive; 2=2 dead/0 alive; leaf damage, 0=0 to 20% leaf consumed; 1=21 to 40% leaf consumed; 2=41 to 60% leaf consumed; 3=61 to 80% leaf consumed; and 4=81 to 100% leaf consumed. Following scoring, insects were weighed on an analytical balance and photographed using a digital camera.

The following sequences exhibited a positive insect control phenotype: SEQ ID Nos: 3, 150, 151, 26, 31, 36, 58, 78, 94, 106, 107, 110, 112, 113, 114, 117, 123.

D. Carbohydrate Screen. The dry residue was transferred from the extracting cartridge (10-20 mg) into a 100×13 mm glass tube containing 0.5 ml of 0.5 N HCl in methanol and 0.12 ml of methyl acetate and then sealed (Teflon coated screw cap) under nitrogen and heated for 16 hours at 800C. The liquid phase was then transferred using an 8-channel pipetter (Matrix) to a glass insert supported by a 96 well aluminum block plate (Modem Metal Craft) and evaporated to dryness (Concentrator Evaparray). The methyl-glycosides and methyl-glycoside methyl esters were silylated in 0.1 ml pyridine and 0.1 ml BSTFA+1% TMCS at room temperature for one hour. The sample generated was analyzed on a DB1 capillary column (15 meters) with an 11 minute program temperature (from 160° C. to 190° C. at 5° C./min and 190° C. to 298° C. at 36° C./minute and hold 2 minutes) and 3 minutes equilibration time. The following components of the plant cell wall were identified in the tobacco sample: arabinose, rhamnose, xylose, galactose, galacturonic acid, mannose, glucuronic acid and glucose.

E. GC/MS Metabolite Analysis: A 3 mm tungsten carbide ball bearing was placed into each well of a 96-well deep well block and 300 μl of grinding buffer (2 mM NaOH, 1 mM PMSF, 10 mM beta-mercaptoethanol, and deuterium-labeled compounds) was added to each well. A 13 mm circle (~20 mg) leaf disc plug from 4 week old *Nicotiana benthamiana* (2 week post-inoculation) apical leaves were placed into the 96-well microtiter deepwell plate. The plate was tightly sealed and placed on a mechanical shaker (paint mixer, up to four at a time) for 2 min, then rotated 180° and shaken for an additional 2 min. Subsequently, the samples were spun for 10 min at 3200 RPM in a refrigerated (15° C.) centrifuge equipped for microtiter plates. Following centrifugation, the 96-well plate containing the homogenized samples was placed on a TECAN GENESIS RSP 200 (TECAN, Research Triangle Park, N.C.) liquid handler/robotics system. Both Logic and Gemini software were used to control the TECAN liquid handler. Approximately 200 μl was transferred to a pre-conditioned (1 ml MeOH followed by 1 ml of distilled deionized $H_2O$) Waters 96-well Oasis HLB solid phase extraction (SPE) plate by the TECAN liquid handler for metabolite analysis by GC/MS. The Waters Extraction Plate Manifold Kit and a vacuum not greater than 5 mm Hg was used to aspirate plant samples from SPE plate into a waste reservoir. The SPE plate was then washed with 1 ml of 5% MeOH in $H_2O$ by aspirating into waste reservoir and compounds eluted from SP resin with 350 μl of MeOH into a 96-well collection plate. Samples were then transferred to GC autosampler vials, capped and stored in the freezer at 80° C. for metabolite analysis.

An internal standard solution was prepared by making a stock solution at a concentration of 1 μg/μl (using compound density). Grinding buffer (2 mM NaOH above) with the internal standard was prepared at a concentration of 10 ng/μl for each (3,000 ng/300 μl) to yield a concentration equivalent of approximately 150 ng/mg wet weight of plant tissue. Following extraction of plant material, this solution was transferred to the SPE plate by the TECAN liquid handler and extracted with 350 μl of MeOH. Approximately 20 μl of the sample will be injected onto a 30 m×0.32 mm DB-WAX (1 μm film thickness) GC column with a large volume injector during the preliminary study. The GC column oven was temperature held at 35 C for 5 min, then programmed at 2.5° C./min to 250° C. and held for 15 min.

Samples that contained peaks that were present in altered levels relative to control samples as identified from chromatograms were further analysis using mass spectroscopy. Samples that were transfected with the following nucleic acid sequences were found to have altered metabolic profiles: SEQ ID NO: 43, 49, 79, 84, and 94. Table 9 shows the retention time and % change in peaks relative to controls for several sequences. Table 9 also shows the identity of the peaks as determined by mass spectroscopy.

TABLE 9

Metabolic Profiles

| SEQ ID NO | RT (MIN) | % Change | Compound |
|---|---|---|---|
| 43 | 10.68 | +130 | Malic Acid |
| 43 | 11.63 | +250 | Ribonic Acid; Gamma-lactone |
| 43 | 12.93 | +260 | Quinic Acid |
| 43 | 14.12 | +120 | Inositol |
| 79 | 10.67 | +300 | Malic Acid |
| 79 | 10.87 | +150 | L-Aspartic Acid |
| 79 | 10.92 | +80 | 5-Oxo-L-Proline (pyroglutamic) |
| 79 | 12.48 | +100 | Ribonic Acid |
| 79 | 12.64 | +800 | Citric Acid |
| 79 | 16.44 | +60 | Sucrose |
| 94 FA | 9.31 | −95 | Dodecanoic Acid (12:0) |
| 94 FA | 10.28 | −90 | Myristic Acid (14:0) |
| 94 FA | 11.20 | +500 | Hexadecenoic Acid (16:1) |
| 94 FA | 11.96 | +200 | Oleic Acid (18:1) |
| 94 | 10.68 | +700 | Malic Acid |
| 94 | 11.63 | +300 | Ribonic Acid; Gamma-lactone |
| 94 | 12.33 | +300 | Phosphoric Acid |
| 94 | 12.65 | −1400 | Citric Acid |
| 94 | 12.93 | +500 | Quinic Aci |
| 94 | 14.12 | +800 | Inositol |
| 49 | 11.0 | New | |
| 49 | 11.7 | New | |

Example 13

Protein Profiling by MALDI-TOF

Approximately 14 days post-inoculation, 960 different *N. benthamiana* leaf plugs transfected with encapsidated virion from a GENEWARE expression library from growth rooms and 38 from *N. benthamiana* infected in Owensboro, Kentucky were collected and the soluble proteins extracted with a high throughput micro-extraction technique described below. An aliquot of this solution was automatically diluted with matrix by a liquid handler in preparation for analysis by MALDI-TOF mass spectrometry for proteins.

A. Sample Preparation by High Throughput Micro-Extraction: A 3 mm tungsten carbide ball bearing was placed into each well of a 96-well deep well block and 300 µl of grinding buffer (2 mM NaOH, 1 mM PMSF, 10 mM beta-mercaptoethanol, and deuterium-labeled compounds-GC/MS analysis) was added to each well. A 13 mm circle (~20 mg) leaf disc plug from ~4 week old *Nicotiana benthamiana* (2 week post-inoculation) apical leaves were placed into the 96-well microtiter deepwell plate. The plate was tightly sealed and placed on a mechanical shaker (paint mixer, up to four at a time) for 2 min, then rotated 180° and shaken for an additional 2 min. Subsequently, the samples were spun for 10 min at 3200 RPM in a refrigerated (15° C.) centrifuge equipped for microtiter plates. Following centrifugation, the 96-well plate containing the homogenized samples was placed on a TECAN GENESIS RSP 200 (TECAN, Research Triangle Park, N.C.) liquid handler/robotics system. Both Logic and Gemini software were used to control the TECAN liquid handler. Samples were diluted by the TECAN liquid handler in a round bottom 96-well plate for MALDI-TOF analysis by adding 18 µl of sinapinic acid matrix and 2 µl of plant extract to each well. Samples were mixed well by aspirating/dispensing 10 µl volumes five times. A 2 µl aliquot of each sample was spotted onto a 100 sample MALDI plate. In addition, a 5.0 µl aliquot of each sample was transferred to a 96-well microtiter plate for PCR and/or MALDI backup analysis and stored at 800C. Two plant trays containing 96 individually infected each were extracted each day for 5 days.

B. MALDI-TOF Mass Spectrometry Analysis: An aliquot of the homogenized plant samples were diluted 1:10 with sinapinic acid (Aldrich, Milwaukee, Wis.) matrix, 2 µl applied to a stainless steel MALDI plate surface and allowed to air dry for analysis. The sinapinic acid was prepared at a concentration of 10 mg/ml in 0.1% TFA/acetonitrile (70/30) by volume. MALDI-TOF mass spectra were obtained with a PerSeptive Biosystems Voyager DE-PRO operated in the linear mode. A pulsed nitrogen laser operating at 337 nm was used in the delayed extraction mode for ionization. An acceleration voltage of 25 kV with a 90% grid voltage and a 0.1% guide wire voltage was used. Approximately 150 scans were acquired and averaged over the mass range of 2000-156,000 Da. with a low mass gate of 2000. Ion source and mirror pressures were approximately $2.2 \times 10^{-7}$ and $8 \times 10^{-8}$ Torr, respectively. All spectra were mass calibrated with a single-point fit using horse apomyoglobin (16,952 Da).

C. Results: This study describes a method that was developed using the high-throughput capabilities of MALDI-TOF MS to detect changes in total protein profiles of crude plant extracts derived from a Genomics GENEWARE expression library. As many as 192 samples per day were extracted and analyzed for protein profiling using MALDI-TOF mass spectrometry. In addition, the method has been optimized in house for detection of a wide range of protein masses from one MALDI-TOF scan. More than 50 proteins were routinely detected in a MALDI profile spectrum ranging from approx. 3,000 to 110,000 Da. In addition to the coat protein (~17,500 Da), both small (~14, 500 Da) and large (~52,750 Da) subunits of RuDP carboxylase were routinely detected in the plant samples. Several other proteins were common to most of the plants analyzed. The most abundant proteins were observed at around 3,386, 3,970, 4,408, 5,230, 7,280 (doubly charged ion for small sub-unit of RuDP carboxylase), 8,334, 9,350, 10,450 (most abundant protein overall), 14,020, 18,006, 19,628, 20,286, 21,173, 24,014, 25,124 and 29,140 (dimer of small sub-unit) Daltons. A series of less abundant proteins were also detected. Up-regulated or novel proteins were detected in 17.3% of the 960 spectrums that were analyzed. This file was entered into the LIMS database.

Example 14

PFam Analysis

In addition to the PFam analysis described above (Tables 1-3), PFam analysis was performed on the remainder of the nucleic acid sequences of the present invention. The results for sequences that fit into a protein family as determined by PFam are shown in Table 10.

The nucleic acid sequences were further analyzed to determine the origin of the nucleic acid. The following sequences were found to be *Nicotiniana benthamiana* sequences: SEQ ID NOs: 1, 2, 81, 121, 123, 124, 125, 129. The following sequences were found to be rice sequences: SEQ ID NOs: 130, 133, 134, 149. The following sequences were found to be poppy sequences: SEQ ID NOs: 148, 146, 145, 144, 143, 142, 141, 140. The remainder of SEQ ID NOs 1-154 not listed above were found to be *Arabidopsis* sequences.

TABLE 10

PFam Analysis

| SEQ ID NO: | PFam Family | Score | P-Value |
| --- | --- | --- | --- |
| 4 | Ribosomal S11 | 191.8 | 9.6e−59 |
| 8 | Serine carbpept | 154 | 2.6e−42 |
| 9 | RF-1 | 83.7 | 2.3e−26 |
| 11 | Spermine synthase | 176.4 | 4.6-49 |
| 15 | RF-1 | 83.7 | 2.3e−26 |
| 23 | Aminotran-3 | 67.3 | 7.7e−23 |
| 26 | Seedstore-2S | 58.8 | 1.2e−13 |
| 31 | RuBisCO-small | 226.3 | 4.5e−64 |
| 36 | Carb-anhydrase | 23.7 | 1.4e−05 |
| 44 | IF4E | 86.1 | 7.4e−22 |
| 45 | Peroxidase | 106.2 | 6.5e−28 |
| 46 | MATH | 25.9 | 7.4e−06 |
| 50 | Peroxidase | 97.5 | 2.6e−25 |
| 51 | PsbP | 188.9 | 8.2e−53 |
| 54 | RuBisCO-small | 201.8 | 1e−56 |
| 61 | Ribosomal-L14 | 193.5 | 3.3e−54 |
| 74 | Ribosomal-L18p | 52.3 | 1e−11 |
| 79 | Histone | 113.1 | 5.5e−30 |
| 83 | Pectinesterase | −26.5 | 6.8e−08 |
| 86 | HSF-DNA-bind | 126.2 | 4.1e−36 |
| 88 | RCC1 | 51.3 | 3.5e−13 |
| 90 | Ubiquitin | 362.9 | 3.4e−105 |
| 99 | Ubiquitin | 216.4 | 4.4e−61 |
| 102 | Ribosomal-S16 | 110.8 | 2.7e−29 |
| 103 | AP2-domain | 158.3 | 1.3e−43 |
| 106 | Ribosomal-L21e | 90.7 | 2.8e−23 |
| 107 | Ribosomal-S20p | 64.1 | 2.9e−15 |
| 111 | Ribosomal-L35Ae | 163.3 | 4.2e−45 |
| 113 | TCTP | 239.4 | 5.1e−68 |
| 117 | Ribosomal-L11 | 149.1 | 7.5e−41 |

Example 15

Ortholog and Homolog Analysis

The nucleic acid sequences of the present invention were further analyzed by translating the nucleic acid sequence into the predicted polypeptide sequence. The corresponding amino acid sequence was then used to search protein databases for orthologs and homologs.

Example 16

ABRC Library Construction in GENEWARE Expression Vectors

Expressed sequence tag (EST) clones were obtained from the *Arabidopsis* Biological Resource Center (ABRC; The Ohio State University, Columbus, Ohio 43210). These clones originated from Michigan State University (from the labs of Dr. Thomas Newman of the DOE Plant Research Laboratory and Dr. Chris Somerville, Carnegie Institution of Washington) and from the Centre National de la Recherche Scientifique Project (CNRS project; donated by the Groupement De Recherche 1003, Centre National de la Recherche Scientifique, Dr. Bernard Lescure and colleagues). The clones were derived from cDNA libraries isolated from various tissues of *Arabidopsis thaliana* var Columbia. A clone set of 11,982 clones was received as glycerol stocks arrayed in 96 well plates, each with an ABRC identifier and associated EST sequence.

An ORF finding algorithm was performed on the EST clone set to find potential full-length genes. Approximately 3,200 full-length genes were found and used to make GENEWARE constructs in the sense orientation. Five thousand of the remaining clones (not full-length) were used to make GENEWARE constructs in the antisense orientation.

Full-length clones used to make constructs in the sense orientation were grown and DNA was isolated using Qiagen (Qiagen Inc., Valencia, Calif. 91355) mini-preps. Each clone was digested with NotI and Sse 8387 eight base pair enzymes. The resultant fragments were individually isolated and then combined. The combined fragments were ligated into pGTN P/N vector (with polylinker extending from PstI to NotI—5' to 3'). For each set of 96 original clones approximately 192 colonies were picked from the pooled GENEWARE ligations, grown until confluent in deep-well 96-well plates, DNA prepped and sequenced. The ESTs matching the ABRC data was bioinformatically checked by BLAST and a list of missing clones was generated. Pools of clones found to be missing were prepared and subjected to the same process. The entire process resulted in greater than 3,000 full-length sense clones.

The negative sense clones were processed in the same manner, but ligated into pGTN N/P vector (with polylinker extending from NotI to PstI—5' to 3'). For each set of 96 original clones approximately 192 colonies were picked from the pooled geneware ligations and DNA prepped. The DNA from the GENEWARE ligations was subjected to RFLP analysis using TaqI 4 base cutter. Novel patterns were identified for each set. The RFLP method was applied and only applicable for comparison within a single ABRC plate. This procedure resulted in greater than 6,000 negative sense clones.

The identified clones were re-arrayed, transcribed, encapsidated and used to inoculate plants.

Example 17

Inoculation of plants

A. Plant Growth. *N. benthamiana* seeds were sown in 6.5 cm pots filled with Redi-earth medium (Scotts) that had been pre-wetted with fertilizer solution (prepared by mixing 147 kg Peters Excel 15-5-15 Cal-Mag (The Scotts Company, Marysville Ohio), 68 kg Peters Excel 15-0-0 Cal-Lite (15% Ca), and 45 kg Peters Excel 10-0-0 MagNitrate (10% Mg) in hot tap water to 596 liters total volume and then injecting this concentrate into irrigation water using an injection system (H. E. Anderson, Muskogee Oklahoma), at a ratio of 200:1). Seeded pots were placed in the greenhouse for 1 d, transferred to a germination chamber, set to 27° C., for 2 d (Carolina Greenhouses, Kinston, N.C.), and then returned to the greenhouse. Shade curtains (33% transmittance) were used to reduce solar intensity in the greenhouse and artificial lighting, a 1:1 mixture of metal halide and high pressure sodium lamps (Sylvania) that delivered an irradiance of approximately 220 µmol $m^2s^{-1}$, was used to extend day length to 16 h and to supplement solar radiation on overcast days. Evaporative cooling and steam heat were used to regulate greenhouse temperature, maintaining a daytime set point of 27° C. and a nighttime set point of 22° C. At approximately 7 days post sowing (dps), seedlings were thinned to one seedling per pot and at 17 to 21 dps, the pots were spaced farther apart to accommodate plant growth. Plants were watered with Hoagland nutrient solution as required. Following inoculation, waste irrigation water was collected and treated with 0.5% sodium hypochlorite for 10 minutes to neutralize any viral contamination before discharging into the municipal sewer.

B. Innoculation. For each GENEWARE™ clone, 180 µL of inoculum was prepared by combining equal volumes of encapsidated RNA transcript and FES buffer (0.1M glycine, 0.06 M $K_2HPO_4$, 1% sodium pyrophosphate, 1% diatomaceous earth (Sigma), and either 1% silicon carbide (Aldrich), or 1% Bentonite (Sigma)). The inoculum was applied to three greenhouse-grown *Nicotiana benthamiana* plants at 14 or 17 days post sowing (dps) by distributing it onto the upper surface of one pair of leaves of each plant (~30 µL per leaf). Either the first pair of leaves or the second pair of leaves above the cotyledons was inoculated on 14 or 17 dps plants, respectively. The inoculum was spread across the leaf surface using one of two different procedures. The first procedure utilized a Cleanfoam swab (Texwipe Co, NJ) to spread the inoculm across the surface of the leaf while the leaf was supported with a plastic pot label (¾×5 2M/RL, White Thermal Pot Label, United Label). The second implemented a 3" cotton tipped applicator (Calapro Swab, Fisher Scientific) to spread the inoculum and a gloved finger to support the leaf. Following inoculation the plants were misted with deionized water.

C. Infection. At 13 days post inoculation (dpi), the plants were examined visually and a numerical score was assigned to each plant to indicate the extent of viral infection symptoms. 0=no infection, 1=possible infection, 2=infection symptoms limited to leaves <50-75% fully expanded, 3=typical infection, 4=a typically severe infection, often accompanied by moderate to severe wilting and/or necrosis.

Example 18

Phenotypic Evaluation

At 13 dpi plants were examined and in cases where a plant's visual phenotype deviated substantially from the phenotypes of control plants, a controlled vocabulary utilizing a five-part phrase was used to describe the plants. Phrase: plant region/subpart/modifier (optional)/symptom/severity. Plant regions: sink leaves (the upper region of the plant considered to be primarily phloem sink tissue at the time of evaluation), source leaves (expanded, fully-infected leaves considered to be phloem source tissue at the time of evaluation), bypassed leaves (leaves [three and four] that display little or no infection symptoms), inoculated leaves (leaves one and two), stem. Subparts: blade, entire, flower, foci, intervein, leaf, lower, major vein, margin, minor vein, node, petiole, shoot apex, upper, vein, viral path. Modifiers: apical, associated, banded, basal, blotchy, bright, central, crinkled, dark, epinastic, flecked, glossy, gray, hyponastic, increased, intermittent, large-spotted, light, light-colored, light-green, mottled, narrowed, orange, patchy, patterned, radial, reduced, ringspot, small-spotted, smooth, spotted, streaked, subtending, uniform, unusual, white. Symptoms: bleaching, chlorosis, color, contortion, corrugation, curling, dark green, elongation, etching, hyperbranching, mild symptoms, necrosis, patterning, recovery, stunting, texture, trichomes, wilting. Severity: 1—extremely mild/trace, 2—mild symptom (<30% of subpart affected), 3—moderate symptom (30%-70% of subpart affected), 4—severe symptom (>70% of subpart affected). Based on the symptoms a phenotypic hit value (PHV) and a herbicide hit value (HHV) were assigned to each plant phenotyped. Phenotype Hit Value: 1—no predicted value; do not request for repeat analysis, 2—of uncertain value, 3—of potential value; strong phenotype, 4—highly unusual phenotype. Herbicide Hit Value: 1—no predicted value; do not request for repeat analysis, 2—of uncertain value, 3—moderate chlorosis (especially in apical region) or necrosis, 4—Severe phytotoxicity/herbicide mode of action. Comments were added if additional information was required to complete the plant characterization. Results are presented in Table 11.

TABLE 11

| SEQ ID NO | DAS/LSBC ID | Library | Summary of Visual Phenotype |
|---|---|---|---|
| SEQ ID NO: 149, 336 | GBSG0000175736 | RICE/OJ | Stunting |
| SEQ ID NO: 10, 288 | GBSG000025015 | ABRC | Stunting |
| SEQ ID NO: 26, 291 | GBSG000025104 | ABRC | Stunting |
| SEQ ID NO: 47 | GBSG000025168 | ABRC | Stunting |
| SEQ ID NO: 48, 297 | GBSG000025170 | ABRC | Stunting |
| SEQ ID NO: 58 | GBSG000025427 | ABRC | Stunting |
| SEQ ID NO: 59, 302 | GBSG000025431 | ABRC | Stunting |
| SEQ ID NO: 69, 304 | GBSG000027424 | ARAB | Stunting |
| SEQ ID NO: 83, 313 | GBSG000030087 | ABRC | Stunting |
| SEQ ID NO: 102, 321 | GBSG000045801 | ABRC | Stunting |
| SEQ ID NO: 103, 322 | GBSG000045804 | ABRC | Stunting |
| SEQ ID NO: 105, 323 | GBSG000045808 | ABRC | Stunting |
| SEQ ID NO: 106, 324 | GBSG000045820 | ABRC | Stunting |
| SEQ ID NO: 107, 325 | GBSG000045837 | ABRC | Stunting |
| SEQ ID NO: 109, 326 | GBSG000045850 | ABRC | Stunting |
| SEQ ID NO: 110, 327 | GBSG000045853 | ABRC | Stunting |
| SEQ ID NO: 111, 328 | GBSG000045855 | ABRC | Stunting |
| SEQ ID NO: 112, 329 | GBSG000045864 | ABRC | Stunting |
| SEQ ID NO: 113, 330 | GBSG000045866 | ABRC | Stunting |
| SEQ ID NO: 114, 331 | GBSG000045869 | ABRC | Stunting |
| SEQ ID NO: 115, 332 | GBSG000045874 | ABRC | Stunting |

Example 19

Metabolic Screens

A. Sample Generation. Individual dwarf tobacco *nicotiana benthamiana*,(Nb) plants were manually transfected with an unique DNA sequence at 14 or 17 days post sowing using the GENEWARE™ viral vector technology (1). Plants were grown and maintained under greenhouse conditions. At 13 days after infection, an infection rating of 0, 1, 2, 3, or 4 was assigned to each plant. The infection rating documents the degree of infection based on a visual observation. A score of 0 indicates no visual infection. Scores of 1 and 2 indicate varying degrees of partial infection. A score of 4 indicates a plant with a massive overload of infection, the plant is either dead or near death. A score of 3 indicates optimum spread of systemic infection.

Samples were grouped into sets of up to 96 samples per set for inoculation, harvesting and analysis. Each sample set (SDG) included 8 negative control (reference samples), up to 80 unknown (test) samples, and 8 quality control samples.

B. Harvesting. At 14 days after infection, infected leaf tissue, excluding stems and petioles, was harvested from plants with an infection score of 3. Infected tissue was placed in a labeled, 50-milliliter (mL), plastic centrifuge tube containing a tungsten carbide ball approximately 1 cm in diameter. The tube was immediately capped, and dipped in liquid nitrogen for approximately 20 seconds to freeze the sample as quickly as possible to minimize degradation of the sample due to biological processes triggered by the harvesting process. Harvested samples were maintained at −80° C. between harvest and analysis. Each sample was assigned a unique identifier, which was used to correlate the plant tissue to the DNA sequence that the plant was transfected with. Each sample set was assigned a unique identifier, which is referred to as the harvest or meta rack ID.

C. Extraction. Prior to analysis, the frozen sample was homogenized by placing the centrifuge tube on a mechanical shaker. The action of the tungsten carbide ball during approximately 30 seconds of vigorous shaking reduced the frozen whole leaf tissue to a finely homogenized frozen powder. Approximately 1 gram of the frozen powder was extracted with 7.5 mL of a solution of isopropanol (IPA): water 70:30 (v:v) by shaking at room temperature for 30 minutes.

D. Fractionation. A 1200 microliter (μL) aliquot of the IPA:water extract was partitioned with 1200 μL of hexane. The hexane layer was removed to a clean glass container. This hexane extract is referred to as fraction 1 (F1). A 90 μL aliquot of the hexane extracted IPA:water extract was removed to a clean glass container. This aliquot is referred to as fraction 4 (F4). The remaining hexane extracted IPA:water extract is referred to as fraction 3 (F3). A 200 μL aliquot of the IPA:water extract was transferred to a clean glass container and referred to as fraction 2 (F2). Each fraction for each sample was assigned a unique aliquot ID (sample name).

E. Sample Preparation & Data Generation

Fraction 1: The hexane extract was evaporated to dryness under nitrogen at room temperature. The sample containers were sealed and stored at 4° C. prior to analysis, if storage was required. Immediately prior to capillary gas chromatographic analysis using flame ionization detection (GC/FID), the F1 residue was reconstituted with 120 μL of hexane containing pentacosane and hexatriacontane which were used as internal standards for the F1 analyses. The chromatographic data files generated following GC separation and flame ionization detection were named with the fraction 1 aliquot ID for each sample and stored in a folder named after the harvest rack (sample set) ID. FIG. 8a summarizes the GC/FID parameters used to analyze fraction 1 samples.

Fraction 2: The F2 aliquot was evaporated to dryness under nitrogen at room temperature and reconstituted in heptane containing 2 internal standards, C11:0 and C24:0. In general, fraction 2 is designed to analyze esterified fatty acids, such as phospholipids, triacylglycerides, and thioesters. In order to analyze these compounds by GC/FID, they were transmethylated to their respective methyl esters by addition of sodium methoxide in methanol and heat. Excess reagent was quenched by the addition of a small amount of water, which results in phase separation. The fatty acid methyl esters (FAMEs) were contained in the organic phase. FIG. 8b summarizes the GC/FID parameters used to analyze fraction 2 samples.

Fraction 3: The F3 aliquot was evaporated to dryness under nitrogen at 40° C. In general, the metabolites in this fraction are highly polar and water-soluble. In order to analyze these compounds by GC/FID, the polar functional groups on these compounds were silylated through a 2-step derivatization process. Initially, the residue was reconstituted with 400 µL of pyridine containing hydroxylamine hydrochloride (25 mg/ml) and the internal standard, n-octyl-β-D-glucopyranoside (OXIME solution). The derivatization was completed by the addition of 400 µL of the commercially available reagent (N,O-bis[Trimethylsily]trifluoroacetamide)+1% Trimethylchlorosilane (BSTFA+1% TMCS). The chromatographic data files generated following GC separation and flame ionization detection were named with the fraction 3 aliquot ID for each sample and stored in a folder named after the harvest rack (sample set) ID. FIG. 8c summarizes the GC/FID parameters used to analyze fraction 2 samples.

Fraction 4: The F4 aliquot was diluted with 90 µL of distilled water and 20 µL of an 0.1 N hydrochloric acid solution containing norvaline and sarcosine, which are amino acids that are used as internal standards for the amino acids analysis. Immediately prior to high performance liquid chromatographic analysis using fluorescence detection (HPLC/FLD), the amino acids in F4 are mixed in the HPLC injector at room temperature with buffered orthophtaldehyde solution, which derivatizes primary amino acids, followed by fluorenyl methyl chloroformate, which derivatizes secondary amino acids. Following HPLC separation and fluorescence detection, chromatographic data files were generated for each sample, named with a sequential number which can be tracked back to the F4 aliquot ID, and stored in a folder named after the harvest rack (sample set) ID. FIG. 8d summarizes the HPLC/FLD parameters used to analyze fraction 4 samples.

F. Data Analysis & Hit Detection. Two complementary methods were used to identify modifications in the metabolic profile of test samples from reference samples. These data analysis methods are called automated data analysis (ADA) and quantitative data analysis. Each fraction from each sample was analyzed by one or both of these methods to identify hits. If either method identified a fraction as a hit, the sample was called a hit for that fraction. Therefore a sample could be a hit for 1 through 4 fractions.

ADA employs a qualitative pattern recognition approach using ABNORM (U.S. Pat. No. 5,592,402), which is a proprietary software utility of the Dow Chemical Company. ADA was performed on chromatograms from all 4 fractions. The ADA process developed a statistical model from chromatograms that ideally depict unaltered (reference) metabolic profiles. This model was then used to identify test sample chromatograms that contain statistically significant differences from the normal (control) chromatograms. Updated models for each fraction were generated for each sample set. Chromatograms identified as hits by ADA, were manually reviewed and the data quality visually verified.

Quantitative data analysis is based on individual peak areas. Quantitative data analysis was applied to specific compounds of interest in fraction 2, fatty acids, and fraction 4, amino acids. The peak areas corresponding to these compounds in these fractions were generated. For fraction 2, the relative percent of the peak areas for the compounds in Table V were calculated for each sample. The average ($\bar{x}$) and standard deviation (STD) of the relative % of the peak areas for the individual compounds were calculated from the reference sample chromatograms analyzed within the sample set. The average and STD were used to calculate a range for each compound. Depending on the compound, this range was typically $\bar{x}+/-3$ or 5 STDs. If the relative percent of the peak area from an unknown was outside this range, the compound was considered to be significantly different from the 'normal' level and the sample was identified as a hit for F2. For fraction 4, the concentration, in micrograms/gram was calculated for each of the amino acids listed in Table 12, from calibration standards analyzed at the same time as the test samples. The amino acid concentrations from reference samples were used to calculate the acceptable range from the $\bar{x}$ and STD for each amino acid. If the amino acid concentration for an unknown falls outside this range, the amino acid was considered to be different from normal and sample was identified as a hit for F4.

TABLE 12

Tobacco Metabolites Monitored in Fractions 2 and 4 by Quantitative Analysis

| Fraction 2 (Fatty Acids) | | Fraction 4 (Amino Acids) | |
|---|---|---|---|
| undecanoic acid methyl ester* | C11:0 | Aspartic Acid | ASP |
| Pentadecanoic acid methyl ester** | C15:0 | Glutamic Acid | GLU |
| Pentadecanoic acid ethyl ester** | C15:0 | Serine | SER |
| palmitic acid methyl ester | C16:0 | Histidine | HIS |
| palmitoleic acid methyl ester | C16:1 | Glycine | GLY |
| iso methylpentadecanoic acid methyl ester | C16:0:Me | Threonine | THR |
| palmitoleic acid methyl ester | C16:2 | Alanine | ALA |
| palmitolenic acid methyl ester | C16:3 | Arginine | ARG |
| iso methylhexadecanoic acid methyl ester | C17:0Me | Tyrosine | TYR |
| Stearic acid methyl ester | C18:0 | Cystine | CY2 |
| Oleic acid methyl ester | C18:1 | Valine | VAL |
| Linoleic acid methyl ester | C18:2 | Methionine | MET |
| Linolenic acid methyl ester | C18:3 | Norvaline* | NVA |
| Arachidic acid methyl ester | C20:0 | Tryptohane | TRP |
| Lignoceric acid methyl ester* | C24:0 | Phenylalanine | PHE |
| | | Isoleucine | ILE |
| | | Leucine | LEU |
| | | Lysine | LYS |
| | | Sarcosine* | SAR |
| | | Proline | PRO |

*Internal Standard
**Surrogate Standard

Shipping Hits. Any F1, F2, or F3 fractions identified as hits by ADA or quantitative analysis, and the most typical null for each fraction for each sample set as identified by ADA, were sent to the Function Discovery Laboratory (see Example 20) for structural characterization of the specific compounds identified. Samples were sealed, packaged on dry ice and shipped for overnight delivery.

Example 20

Identification of Metabolic Changes

This Example describes the identification of the chemical nature of genetic modifications made in tobacco plants using GENEWARE viral vector technology. The protocols involved the use of gas chromatography/mass spectrometry (GC/MS) for the analyses of three primary fractions obtained from extraction and fractionation processes.

A. Methods. Major instruments and accessories used included Bioinformatics computer programs, mass spectral libraries, Biotech databases, Nautilus LIMS system (BLIMS; Dow), Biotech Database (eBRAD; Dow), HP Model 6890 capillary Gas Chromatograph (GC; Agilent Technologies), HP Model 5973 Mass Selective Detector (MSD; Agilent Technologies), Auto Sampler and Sample Preparation Station (Leap Technologies), Large Volume Injector system (APEX), Ultra Freezer (Revco), and model LS1006 Barcode Reader (Symbol Technologies).

Samples and corresponding References (also referred to as controls or nulls) were shipped via overnight mail. Samples were removed from the shipping container, inspected for damage, and then placed in a freezer until analysis by GC/MS.

Samples were received in vials or in titer plates with a bar-coded titer plate (TP) number, also referred to as a Rack Identification number that is used to track the sample in the BLIMS system. The barcode number is used by the FDL to extract from BLIMS pertinent information from ADA (Automated chromatographic pattern recognition Data Analysis) HIT reports and/or QUANT (a quantitative data analysis approach that makes use of individual peak areas of select peaks corresponding to specific compounds of interest in the fatty acid Fraction 2) HIT reports generated by the Metabolic Screening Laboratory. The information in these reports includes the well position of the respective HITs (Samples), the corresponding well position of the Reference, and other pertinent information, such as, aliquot identification. This information is used to generate ChemStation and Leap sequences for FDL analyses.

Samples were sequenced for analysis in the following order:

TABLE 13

Analysis Order

Solvent Blank
Instrument Performance Standard
Samples and Associated Reference
.
.
.
Performance Standard
Solvent Blank Samples were analyzed on GC/MS systems using the following procedures. Fraction 1 samples were shipped dry and required a hexane reconstitution step. Fraction 2 and Fraction 3 samples were analyzed as received. Internal standards were added to the samples prior to analysis.

B. Fraction 1 Analysis. The name of the GC/MS method used is BIONEUTx (where x is a revision number of the core GC/MS method). The method is retention-time locked to the retention time of pentacosane, an internal standard, using the ChemStation RT Locking algorithm.

Internal Standard(s)
Pentacosane
Hexatriacontane

| Chromatography | |
|---|---|
| Column: | J&W DB-5MS |
| | 50 M × 0.320 mm × 0.25 μm film |
| | Mode: constant flow |
| | Flow: 2.0 mL/min |
| | Detector: MSD |
| | Outlet psi: vacuum |
| Oven: | 40° C. for 2.0 min |
| | 20° C./min to 350° C., hold 15.0 min |
| | Equilibration time: 1 min |
| Inlet: | Mode: split |
| | Inj Temp: 250° C. |
| | Split ratio: 50:1 |
| | Gas Type: Helium |
| LEAP Injector: | |
| Injector: | Inj volume: optimized to pentacosane |
| | peak intensity (typically 20 μL) |
| | Sample pumps: 2 |
| | Wash solvent A: Hexane |
| | Wash solvent B: Acetone |
| | Preinj Solvent A washes: 2 |
| | Preinj Solvent B washes: 2 |
| | Postinj Solvent A washes: 2 |
| | Postinj Solvent B washes: 2 |
| APEX Injector | |
| Method Name: | BIONEUTx (where x is a revision number of the core APEX method). |
| Modes: | Initial: Standby (GC Split) |
| | Splitless: (Purge Off) 0.5 min |
| | GC Split: (Standby) 4 min |
| | ProSep Split: (Flow Select) 23 min |
| Temps: | 50° C. for 0.0 min. |
| | 300° C./min to 350° C., hold for 31.5 min |
| Mass Spectrometer | |
| Scan: | 35-800 Da at sampling rate 2 (1.96 scans/sec) |
| Solvent delay: | 4.0 min |
| Detector: | EM absolute: False |
| | EM offset: 0 |
| Temps: | Transfer line: 280° C. |
| | Ion source: 150° C. |
| | MS Source: 230° C. |

C. Fraction 2 Analysis: The name of the GC/MS method used is BIOFAMEx (where x is a revision number of the core GC/MS method). The method is retention-time locked to RT of undecanoic acid, methyl ester, an internal standard, using the ChemStation RT Locking algorithm.

Internal Standard(s)
Undecanoic acid, methyl ester
Tetracosanoic acid, methyl ester

| Chromatography | |
|---|---|
| Column: | J & W DB-23 FAME |
| | 60 M × 0.250 mm × 0.15 μm film |
| | Mode: constant flow |
| | Flow: 2.0 mL/min |
| | Detector: MSD |
| | Outlet psi: vacuum |
| Oven: | 50° C. for 2.0 min |
| | 20° C./min to 240° C., hold 10.0 min |
| | Equilibration time: 1 min |
| Inlet: | Mode: split |
| | Inj Temp: 240° C. |
| | Split ratio: 50:1 |

-continued

| | |
|---|---|
| LEAP Injector: | Gas Type: Helium |
| Injector: | Inj volume: optimized to undecanoic acid, methyl ester peak intensity (Typically 10 µL) |
| | Sample pumps: 2 |
| | Wash solvent A: Methanol |
| | Wash solvent B: Methanol |
| | Preinj Solvent A washes: 2 |
| | Preinj Solvent B washes: 2 |
| | Postinj Solvent A washes: 2 |
| | Postinj Solvent B washes: 2 |
| APEX Injector | |
| Method Name: | BIOFAMEx (where x is a revision number of the core APEX method). |
| Modes: | Initial: GC Split |
| | Splitless: 0.5 min |
| | GC Split: 4 min |
| | ProSep Split: 21 min |
| Temps: | 60° C. for 0.5 min. |
| | 300° C./min to 250° C., hold for 20 min |
| | 300° C./min to 260° C., hold for 5 min |
| Mass Spectrometer | |
| Scan: | 35-800 Da at sampling rate 2 (1.96 scans/sec) |
| | Solvent delay: 4.5 min |
| Detector: | EM absolute: False |
| | EM offset: 0 |
| Temps: | Transfer line: 200° C. |
| | Ion source: 150° C. |
| | MS Source: 230° C. |

D. Fraction 3 Analysis. The name of the GC/MS method used is BIOAQUAx (where x is a revision number of the core GC/MS method). Method is retention-time locked to the RT of n-Octyl-β-D-Glucopyranoside, an internal standard, using the ChemStation RT Locking algorithm.

Internal Standard(s)
n-Octyl-β-D-Glucopyranoside

| | |
|---|---|
| Chromatography | |
| Column: | Chrompack 7454 CP-SIL 8 |
| | 60 M × 0.320 mm × 0.25 µm film |
| | Mode: constant flow |
| | Flow: 2.0 mL/min |
| | Detector: MSD |
| | Outlet psi: vacuum |
| Oven: | 40° C. for 2.0 min |
| | 20° C./min to 350° C., hold 10.0 min |
| | Equilibration time: 1 min |
| Inlet: | Mode: split |
| | Inj Temp: 250° C. |
| | Split ratio: 50:1 |
| | Gas Type: Helium |
| LEAP Injector: | |
| Injector: | Inj volume: Optimized to n-Octyl-β-D-Glucopyranoside peak intensity (Typically 2.5 µL) |
| | Sample pumps: 2 |
| | Wash solvent A: Hexane |
| | Wash solvent B: Acetone |
| | Preinj Solvent A washes: 2 |
| | Preinj Solvent B washes: 2 |
| | Postinj Solvent A washes: 2 |
| | Postinj Solvent B washes: 2 |
| APEX Injector | |
| Method Name: | BIOAQUAx (where x is a revision number of the core APEX method). |

-continued

| | |
|---|---|
| Modes: | Initial: GC Split |
| | Splitless: 0.5 min |
| | GC Split: 4 min |
| | ProSep Split: 20 min |
| Temps: | 60° C. for 0.5 min. |
| | 300° C./min to 350° C., hold for 21.1 min |
| Mass Spectrometer | |
| Scan: | 35-800 Da at sampling rate 2 (1.96 scans/sec) |
| | Solvent delay: 4.0 min |
| Detector: | EM absolute: False |
| | EM offset: 0 |
| Temps: | Transfer line: 280° C. |
| | Ion source: 150° C. |
| | MS Source: 230° C. |

E. Performance Standard: Two mixtures were used as instrument performance standards. One standard was run with Fraction 1 and 3 samples and the second was run with Fraction 2 samples. Below is the composition of the standards as well as approximate retention time values observed when run under the GC/MS conditions previously described. These retention time values are subject to change depending upon specific instrument and chromatographic conditions.

TABLE 14

Fraction 1 and 3 Performance Standard

| Time | Compound |
|---|---|
| 6.25 | dimethyl malonate |
| 7.25 | dimethyl succinate |
| 8.15 | dimethyl glutarate |
| 8.98 | dimethyl adipate |
| 11.06 | dimethyl azelate |
| 11.42 | hexadecane |
| 11.70 | dimethyl sebacate |
| 13.57 | eicosane |
| 15.36 | tetracosane |
| 16.88 | octacosane |
| 18.26 | dotriacontane |
| 19.95 | hexatriacontane |

TABLE 15

Fraction 2 Performance Standard

| Time | Compound |
|---|---|
| 8.82 | undecanoic acid, methyl ester |
| 9.32 | dodecanoic acid, methyl ester |
| 10.24 | tetradecanoic acid, methyl ester |
| 11.07 | hexadecanoic acid, methyl ester |
| 11.84 | octadecanoic acid, methyl ester |
| 11.90 | oleic acid, methyl ester |
| 12.14 | linoleic acid, methyl ester |
| 12.39 | linoleic acid, methyl ester |
| 12.60 | eicosanoic acid, methyl ester |
| 13.42 | docosanoic acid, methyl ester |

F. Data Analysis. Sample and Reference data sets were processed using the Bioinformatics computer program Maxwell. The principal elements of the program are 1) Data Reduction, 2) two-dimensional Peak Matching, 3) Quantitative Peak Differentiation (Determination of Relative Quantitative Change), 4) Peak Identification, 5) Data Sorting, and 6) Customized Reporting.

The program queries the user for the filenames of the Reference data set and Sample data set(s) to compare against the Reference. A complete listing of user inputs with example input is shown below.

TABLE 16

Bioinformatics Analysis

| USER QUERY | EXAMPLE USER INPUT |
|---|---|
| Operator Name | M. Maxwell |
| Total number of data files to process | 5 |
| Which Fraction | 3 |
| Reference (Control) File Name | AAPR0020.D |
| Process a specific RT Range | Y |
| Specific RT range | 6.5–23 |
| Internal Standard Retention Time | 14.902 |
| +/− variation in Internal Std. RT | .004 |
| Variation in peak RI, ChemStation | .005 |
| Percent variation in peak RI, Biotech Database | .010 |
| Threshold for determining Area % change | 60 |
| Spectral Matching Value (Threshold MS-XCR for peaks to be a match) | .95 |
| Percent to determine LOP-PM* Value | 1 |
| Percent to determine LOP-SRT** Value | 3 |
| Quality Level for Library (Library match) | 80 |
| Subtract Background | Y |
| Time Range for Background | 21.5–22.6 |
| SHORT SUMMARY (y/n, y = no chromatograms) | Y |

*LOP-PM-Limit of Processing for Peak Mathcing
**LOP-SRT-Limit of Processing for Sorting The program integrates the Total Ion Chromatogram (TIC) of the data sets using Agilent Technologies HP ChemStation integrator parameters determined by the analyst. The corresponding raw peak areas are then normalized to the respective Internal Standard peak area. It should be noted that before the normalization is performed, the program chromatographically and spectrally identifies the Internal Standard peak. Should the identification of the Internal Standard not meet established criteria for a given Fraction, then the data set will not be further processed and it will be flagged for analyst intervention.

Peak tables from the Reference and each Sample were generated. The peak tables are comprised of retention time (RT), retention index (RI)—the retention time relative to the Internal Standard RT, raw peak areas, peak areas normalized to the Internal Standard, and other pertinent information.

The first of two filtering criteria, established by the analyst was then invoked and must be met before a peak is further processed. The criterion is based upon a peak's normalized area. All normalized peaks having values below the Limit of Processing for Peak Matching (LOP-PM), were considered to be "background". These "peaks" were not carried forth for any type of mathematical calculation or spectral comparison.

In the initial peak-matching step, the Sample peak table was compared to the Reference peak table and peaks between the two were paired based upon their respective RI values matching one another (within a given variable window). The next step in the peak matching routine utilized mass spectral data. Sample and Reference peaks that have been chromatographically matched were then compared spectrally. The spectral matching was performed using a mass spectral cross-correlation algorithm within the Agilent Technologies HP ChemStation software. The cross-correlation algorithm generates an equivalence value based upon spectral "fit" that was used to determine whether the chromatographically matched peaks are spectrally similar or not. This equivalence value is referred to as the MS-XCR value and must meet or exceed a predetermined value for a pair of peaks to be "MATCHED," which means they appear to be the same compound in both the Reference and the Sample. The MS-XCR value can also be used to judge peak purity. This two-dimensional peak matching process was repeated until all potential peak matches were processed. At the end of the process, peaks are categorized into two categories, MATCHED and UNMATCHED.

A second filtering criterion was next invoked, again based upon the normalized area of the MATCHED or UNMATCHED peak. For a peak to be reported and further processed, its normalized area must meet or exceed the predetermined Limit of Processing for Sorting (LOP-SRT).

Peaks that are UNMATCHED are immediately flagged as different. UNMATCHED peaks are of two types. There are those that are reported in the Reference but appear to be absent in the Sample (based upon criteria for quantitation and reporting). These peaks were designated in the Analyst Report with a percent change of "−100 percent" and the description "UNMATCHED IN SAMPLE." The second types of peaks are those that were not reported in the Reference (again, based upon criteria for quantitation and reporting) but were reported in the Sample, thus appearing to be "new" peaks. These peaks were designated in the Analyst Report with a percent change of "100 percent" and the description "NEW PEAK UNMATCHED IN NULL."

MATCHED peaks were processed further for relative quantitative differentiation. This quantitative differentiation is expressed as a percent change of the Sample peak area relative to the area of the Reference peak. A predetermined threshold for change must be observed for the change to be determined biochemical and statistically significant. The change threshold is based upon previously observed biological and analytical variability factors. Only changes above the threshold for change were reported.

Peaks were then processed through the peak identification process as follows. The mass spectra of the peaks were first searched against mass spectral plant metabolite libraries. The equivalence value assigned to the library match was used as an indication of a proper identification.

To provide additional confirmation to the identity of a peak, or to suggest other possibilities, library hits were searched further against a Biotechnology database. The Biotechnology database is based on the Access database program from Accelrys (formerly Synopsis) and utilizes Accord for Access (also available from Accelrys) to incorporate chemical structures into the database.

The Chemical Abstract Services (CAS) number of the compound from the library was searched against those contained in the database. If a match was found, the CAS number in the database was then correlated to the data acquisition method for that record. If the method was matched, the program then compared the retention index (RI), in the Peak Table, of the component against the value contained in the database for that given method. Should the RI's match (within a given window of variability) then the peak identity was given a high degree of certainty. Components in the Sample that are not identified by this process were assigned a unique identifier based upon Fraction Number and RI (example: F1-U0.555). The unique identifier was used to track unknown components. The program then sorts the data and generates an Analyst Report.

An Analyst Report is an interim report consisting of PBM algorithm match quality value (equivalence value), RT, Normalized Peak Area, RI (Sample), RI (database) Peak Identification status [peak identity of high certainty (peaks were identified by the program based on the pre-established criteria) or criteria not met (program did not positively identify the component)], Component Name, CAS Number, Mass Spectral Library (containing spectrum most closely matched to that of the component), Unknown ID (unique identifier used to track unidentified components), MS-XCR value, Relative % Change, Notes (TCHED/UN-MATCHED), and other miscellaneous information. The Analyst Report was reviewed manually by the analyst who determined what further analysis was necessary. The analyst also generated a modified report, for further processing by the program, by editing the Analyst Report accordingly.

For Fractions 2 and 3, derivatization procedures were performed prior to analysis to make the certain components more amenable to gas chromatography. Thus, the compound names in the modified analyst report (MAR) were those of the derivatives. To accurately reflect the true components of these fractions, the MAR was further processed using information contained in an additional database. This database cross-references the observed derivatized compound to that of the original, underivatized "parent" compound by way of their respective CAS numbers and replaces derivatives with parent names and information for the final report. In addition, any unidentified components were assigned a "999999-99-9" CAS number.

The Modified Analyst Report also contains a HIT Score of 0, 1, or 2. The value is assigned by the analyst to the data set of the Sample aliquot based on the following criteria:
 0 No FDL data on Sample
 1 FDL data collected; Sample not FDL HIT
 2 FDL data collected; Sample is FDL HIT An FDL HIT is defined as a reportable percent change (modification) observed in a Sample relative to Reference in a component of biochemical significance.

An electronic copy of the final report is entered into the Nautilus LIMS system (BLIMS) and subsequently into eBRAD (Biotech database). The program also generated a hardcopy of the pinpointed TIC and the respective mass spectrum of each component that was reported to have changed.

"NQ" and "NEW" are two terms used in the final report. Both terms refer to UNMATCHED peaks whose percent changes cannot be reported in a numerically quantitative fashion. These terms are defined as follows:

"NQ" is used in the case where there was a peak reported in the Reference for which there was no match in the Sample (either because there was no peak in the Sample or, if there was, the area of the peak did not satisfy the Limit of Processing for Peak Matching). The percent change designation of "—100%" used in the Analyst report is replaced with "NQ".

"NEW" is used in those situations where a peak was reported in the Sample but for which there was no corresponding match in the Reference (either because there was no peak in the Reference or, if there was, the area of the peak did not satisfy the Limit of Processing for Peak Matching). For these situations, the percent change designation of "100%" used in the Analyst Report is replaced with "NEW". The designation of "NEW" in the final report to a component that is present in the Sample but not in the Reference was necessary to eliminate any ambiguity with the appearance of "100%" for MATCHED peaks. A "100%" designation in the final report exclusively refers to a component with modification that doubled in the Sample relative to the Reference.

G. Results. The results of the metabolic screening are summarized in FIGS. 10a-10ffff. Transfection with 55 of the inserts resulted in measurable metabolic changes.

All publications and patents mentioned in the above specification are herein incorporated by reference. Various modifications and variations of the described compositions and methods of the invention will be apparent to those skilled in the art without departing from the scope and spirit of the invention. Although the invention has been described in connection with particular preferred embodiments, it should be understood that the inventions claimed should not be unduly limited to such specific embodiments. Indeed, various modifications of the described modes for carrying out the invention which are obvious to those skilled in the art and in fields related thereto are intended to be within the scope of the following claims.

SEQUENCE LISTING (571 sequences)

SEQ ID NO: 1 - DNA, 817 bp, Nicotiana benthamiana
agcaatcttaactccgccttctacctcgatctcccaacagaggcaacccttgcccaacttctctgaaacacgcatcaccattgcacctctctgctctccgtactcacttgggcagtatgagaagcaatatgtttacggggttcacgaggctttgcaagggtcttgcggttgtgcttgtgggcggtcacattgttgtccagattcttccttctgctctttcctatcttgctctcatccctgtcaagatgaggacgttgcatggagctggagggatggatttctcccacctgatgatcatcatctttaatattctcaatttgtctacgaggagaggatgatatttcattagcccagccttcattttccgcattggatattcgactctcctcattactatattgcgggtaactgcataataagtgaaccggggaggtaccatgcaacggtgtggccggtctgctagagacaggggtgttgtttcccgatagccggccgtgtttcacccgctttttcgctgtgttgtgccagcttctaagagctgttgccacattatcaccaaagattataggtttcattgatgttcccatctgcaaatttcaccaaatctctcagcactaatttatctttataagagtttttgttgtgaaaagggaagactagtttagttatagagtacctgtgtgaccaaggcataaagagggagagtcacatagctgcaatggacctgtatgatcaccctgaaacaagaaacaaaaactatcaatatagaaggaattaaaatatgcatctttaattgttcgaacaaaaaaaaaaaaaa

SEQ ID NO: 2 - DNA, 813 bp, Nicotiana benthamiana
tgctgattttgggtatacaactgaaatgtttgagaaggacatggagctttggcaacgaagggttgaacattactggaatcttttaagtccaaagatctcttcagacagtctgagaaacatcatggatatgaaggccaatttggggtcatttgctgctgctttgaaggacaaagatgtttgggtcatgaatgttgtatccaaagatggacctaacactctcaagattgtatatgaccgtggtttgatcggcacaactcatgactggtgtgaagcattttcgacatatcctaggacctatgatttggtccatgcgtggagtgttttctctgacattgaaaagaaaggttgcagcggtgaggatctgttactcgagatagatcgcatactaaggcctagtggttttgttatcttcaacgacaaacaacatgttattgactttgtaaagaagtatttatcggcattgcactgggaagcagtagctgatccaacttcagatccagaccaagaaggagatgacattgtttttatcatccaaaagaaaatgtggctgacaagtgaaagcatcagagatacagagtaaataaagtttgccactaagtacacttcttgattcattttccccttccttttgggattaagaaatacacacccctaaaggtttgggagatatcagtttgattttgtagtatttatgatatttatttcttccttttcttcattaacttaatttcaacttgttgtttcttttaattgataaacaaactcatagactatatatgcatttataggctattctcgaaaaaaaaaaaaaaa

SEQ ID NO: 3 - DNA, 945 bp, Arabidopsis thaliana
gaagcacgaacggcgtcgggttagtccgacggaggaaccatgtcctcgtctcttcttctctccggttctactgtatcttcttcgtttatcgctccatctaagccttctctcgtacgaaattccagtaagacatcactgttaccatttcgtaatgtttcgagaagcttcaaaaccgtcaagtgcaccgttgattcttcatatggaggcaatgttcccacgttccctcggacgagagtttgggacccgtacaaacgtctaggagttagtccatatgcttccgaggaagaaatctgggcctctcgtaactttcttttacagcagtacgctggacatgaaagaagcgaagagtctatagaaggagcctttgagaagcttctcatgtctagttttatcagaaggaagaagactaaaatcaatcttaaatcaaagttgaagaagaaagttgaggaatctcctccgtggctcaaagctcttctcgatttcgttgaaatgcctcccatggacactattttcagaagacttttcctctttgccttcatgggtggttggagtatcatgaactctgcagaaggcggtcctgcgtttcaggtggcggtatcattggctgcgtgcgtatattttctgaatgagaagacaaagagcttggggagagcttgcttaatcggaattggagctttagttgccgggtggttctgcggttcgttaatcattcccatgattccgacgtttctcattcagcctacatggacactcgagctcctaacatcactggtcgcttatgtgtttttgtttctttcttgtactttcctcaagtaagttacgttgtggttttatccaaactctttttgttcttttcgcccagacatttacagaacctttcggaaaaattagtgaaagttgttaagtgaaaaaaaaaaaaaaagggcggccgcaccctaggccagt

SEQ ID NO: 4 - DNA, 945 bp, Arabidopsis thaliana; identical to SEQ ID NO: 3

SEQ ID NO: 5 - DNA, 899 bp, Arabidopsis thaliana
aaaggatttgctctgagggctgggctcgggggtcccagttccgaacccgtcggctgtcagcggactgctcgagctgcttccgcggcgagagcgggtcgccgcgtgccggccgggggacggactgggaacggctctctcgggagctttccccgggcgtcgaacagtcagctcagaactggtacggacaaggggaatccgactgtttaattaaaacaaagcattgcgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagcttcggcgcaagtgaaataccactacttttaacgttattttacttactccgtgaatcggaggcggggtacaacccctgtttttggtcccaaggctcgcttcggcgggtcgatccgggcggaggacattgtcaggtggggagtttggctggggcggcacatctgttaaaagataacgcaggtgtcctaagatgagctcaacgagaacagaaatctcgtgtggaacaaaataccactacttttaacgttattttacttactccgtgaatcggaggcggggtacaacccctgtttttggtcccaaggctcgcttcggcgggtcgatccgggcggaggacattgtcaggtggggagtttggctgggg

SEQ ID NO: 6 - DNA, 288 bp, Arabidopsis thaliana
tgactgattactactacttgtactaactctaatacatttacaaaacaagtcctccttttccccaagtatacagataaagatttaccagaaccggttttccgccttcatctcacatggaaatcgtaaggagaagacgcatacacttgatctggaaccactagtggtaacttctcaatgtacataaacaatcgtttctggttctctctagcgattgcagtgagattcactgtatcgttttggtccaaaaacatccagagatcacctgaatctactcttttaaggctgtct

SEQ ID NO: 7 - DNA, 452 bp, Arabidopsis thaliana
acctccagccctgatgatggtgtatggaataccggaatcagccaagtattgctcagcctttctcttccagaccagaatgttagcattgccaatactattgagagggtgattaatgtttgttcctcccatcgacccaaccaaaacaatctgcttaactcctgcagagacagccttaaaagagtagattcaggtgatctctggatgtttttggaccaaaacgatacagtgaatctcactgcaatcgctagagagaaccagaaacgattgtttatgtacattgagaagttaccactagtggttccagatcaagtgtatgcgtcttctccttacgatttccatgtgagatgaaggcggaaaaccggttctggtaaatctttatctgtatacttggggaaaaggaggacttgttttgtaaatgtattagagttagtacaagtagtagtaatcagtca

SEQ ID NO: 8 - DNA, 552 bp, Arabidopsis thaliana
aaaagccctccatgtcccaccaggacttgcaccatcaaaatgggatacttgcagtgatgtcgtgagtgaacactggaatgactctccttcctcggttctaaacatttaccacgagcttatagctgctgggcttcgtatctgggttttcagtggggacgcagatgccgttgtaccagtcacatcaacccggtacagtatcgatgcactaaaccttcgtcctttgagtgcctatggtccttggtacttagatggacaggtgggagggtggagtcagcagtatgctggtctgaactttgtgacagtgagaggtgcaggccatgaagttcctttgcacagaccgaagcaagctcttgcgctcttcaaggcttttatatctggaactccattgtccacacatgagaacagcatcagccgcgacatgtctgaactcgttagtgactcataatgagttctgatttgatgtaatgtgtgatttggattctcaatcaaaaactttccacataggccgttgaaataagaagagggaaagagaataaatcagtgttttaagtg

SEQ ID NO: 9 - DNA, 391 bp, Arabidopsis thaliana
ttttgaatgaataaaagtcttataattatgatgtgtgtacaactacaaagttttccttggagtatagtttgaggatttatccagaagtagcagaagaagcagctacagactcggagagttcttccatgagttccttttgctccaaagcagcacaagcctgcactgcgtcctctaaagcaccgtcaagaaatgttgtaagcgcaaagttcatctttagcctatgatcagtcactctactgtccttataattgtatgttcttatcttttctgaacgagctccagtcccaacctgagatttcctttcattccttatcttctcttgttgttcccttacttttatttcatacagttttgctcgcagaagctggaaagcacgcgccttattcctaat

SEQ ID NO: 10 - DNA, 200 bp, Arabidopsis thaliana
ctgcagctgtgtgctccttagctaaggtggcaatggcagacgatgagccaaagagaggaacagaagctgccaagaagaagtatgctccagtctgtgtcacaatgcctaccgccaagatatgccgtaactgagtttgctatttaaccagcaactgtatctatgtcgtataactattctcagtgtggtttgtaaggatcata

SEQ ID NO: 11 - DNA, 1063 bp, Arabidopsis thaliana
tggttctctgagattagtcctatgtggccaggagaagcacattctctcaaggtagagaagattctattccaagggaaatcagattaccaggatgttattgttttccagtctgcaacatatggaaaggttttggttttggatggagtgattcaactcactgagagagatgaatgtgcgtatcaagaaatgatcactcatcttcctttgtgctctatctccaaccccaaaaaggtactggtgattggaggaggagatggaggagtcctgagggaagtggcacgtcatagttctgttgagcagattgacatttgtgaaatagataaaatggtggttgatgtggctaagcagtatttccctaatgtagcagttggatacgaggatcctcgtgtcaacctcatcattggcgatggtgttgctttcttgaagaacgctgctgaaggaacctatgatgcagttattgttgattcatctgatccaatcggtccagcaaaagagctatttgagaaacctttctttgagtcagtgaatagagctcttcgtcctggtggagttgtgtgcacacaagctgaaagcttgtggcttcacatggatatcattgaagacattgtttctaattgccgtgacatctttaaaggatctgttaactacgcttggaccagtgttccaacttacccgagtggagtcattggattcatgctttgttcatctgaaggaccacaagtcgatttcaagaagccagtgagtctaatcgatactgatgaaagctctatcaaatcacactgtcccttgaagtattacaacgctgagattcactcagctgctttctgcttgccctcttttgctaagaaggtgattgattcgaaagccaactagaaaagagaagagaaatcatttgctttagagaaacttcatgtggaagtgataatatgatgatacaatgatcctttggaaaaaaataaagaagttttaatttttagaatgtaatgttctttcacctgcaatgttatgtgactgcactgagctatcaatctctttttataagcattacacatatttcaaaaaa

SEQ ID NO: 12 - DNA, 1173 bp, Arabidopsis thaliana
aaatccccaaattttcaacaaggataagagccggaagctcatcgccggtgaacggaactagggtttcattcatccccaaattgataacaagaaaatggctcatgcttgcgtctctacatcggcttcttctctcagattcacagctggattcgtctccgctagtcccaatggctcctctttcgattctcccaagctttctcttcctttcgagcctctccgttcaaggaagacgaataagttagttagcgatagaaagaattggaagaattcaactccgaaagctgtatattccggcaatctctggacaccggagattccgtctcctcaaggagtttggtccattagagatgatttacaagtcccttcttcgccgtattttcctgcttatgctcaaggacaaggaccacctcctatggtgcaagaacgtttccagagtatcattagtcagctcttccaatataggattattcgctgtggtggtgctgtggatgacgatatggcaaacataattgtagctcaactcctgtatcttgatgctgttgatcctactaaggatattgtcatgtatgttaattctcctggtggatcagttacagctggcatggctatattcgatactatgaggcacatccggcctgatgtgtccactgtttgtgttggtctagctgctagtatgggagcttttctgcttagtgctggaaccaaaggaaaaagatacagtctaccaaactcaaggataatgatccatcagccgcttggtggagctcaaggtggccaaaccgacattgacattcaggcaaatgaaatgctgcatcacaaggcaaacctaaacggttacctcgcataccacactggtcaaagcctggagaagataaaccaggacacagaccgtgatttcttcatgagtgccaaagaagcaaaagagtatggacttatcgacggtgttatcatgaaccctcttaaagctctccagccacttgcagcagcttaatcgcctaaaggtagtggttcagctttagcacttgttcttttttgggcctttgatgaactgagattttccatgaaatatgtttctattctacaaggaaaatcagatttgtttgggatcaaactctgtagttgatacatacatgaagaccaaagtaaagtttcttactgtgctgaaaaaaaaaa

SEQ ID NO: 13 - DNA, 959 bp, Arabidopsis thaliana
agaaacgatgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatagcgtaaaaggctaaaactccacccactagatatcggatcgtatcttataaaccatataatatacgaatacgattaataatatatcaaaaagattggaaataggtgtgctttttgaaattagtgagcgttttttatggaaaagaaaagaaaagaaagcagttggcgtctggataaagggaaggaggagaatctttagattttttctttaatctgtttttcttttgtcttgattagttttttctttagtggtggtggttgtgagttagtgtgtaaaatgtatattgtcatatgtgaatttaataataagtccttttgtaagatgatcaagggaaaaaaaaaaaaaa

SEQ ID NO: 14 - DNA, 250 bp, Arabidopsis thaliana
gcagcacttgtctgacccatggcacaacactattgtccaaaccttcaactaaagagtgaagacagacttatgatctcatacctatctatcttccatcactttcatgtctgtctgtgagtgtgtttcatcttagagttcttggtttttgagcttgaattattgttgaaccgttgtagctccatgaacaaatttggaatcttcaatgtacagaggaactaagttaatcaacattgttgtactctttaaaaaa

SEQ ID NO: 15 - DNA, 391 bp, Arabidopsis thaliana; identical to SEQ ID NO: 9

SEQ ID NO: 16 - DNA, 1004 bp, Arabidopsis thaliana
agaactagtcagtttctttgttttagacaacaagaatctgtgaactaacacaaaaacattgaaagaatgatcttaacaatgaaacttgttcaccctctccatcactctttgtcttcctccattccctttccctcaagaaaaaggcaatccaaaccgtaccggtgctcgttaccttctcccggctgcgaaaaggtcatcagaacagagactgtcctgcctccggcgccggtgagttgtgaagggagaagggtcttacttggatgtcttctcgctacagcttctgggattttgtcaactggttcagccgaggcagtaagcaccagtagaagagctctacgtgcatccaagttaccggaaagcgatttcacgactctccccaatggtctcaagtactatgatataaaggttggcaatggagcagaggctgtgaaaggatctcgggtcgcagttcactatgttgcaaaatggaaagggataacgttcatgacaagtcgacaaggacttggtgttggaggtggaacgccttatgggtttgacgttggtcaatcagagagaggcaatgttctgaaaggacttgatcttggtgttgaagggatgcgtgtaggcggtcagagattggtgattgttcctcccgagctggcttacgggaagaaaggagtgcaagagattcctccaaacgctacgatagagcttgacattgagctgttatcaatcaagcagagtcctttcgggacgccagtgaagatagttgaaggctaaaaggactaatgaagccaacattgtaccaagattttctgtgtacattcagtaaaaaactataaaattgatcaaagctatggaagattcaactgtatgagaagaatctgtttaatggattataccggctagtccggttttgtaaccgctttataactgtgtctcatcactcaattcatacacttttggccgttttgcaaaaaaaaaaaaaaaaaaaaaaaaaaaaaaaaaaaaaaaaaaaaaaaaaa

SEQ ID NO: 17 - DNA, 397 bp, Arabidopsis thaliana
atagacatgtttcttcgcggtcaccacatagcaagcattctcagcacaagaacactctctactcttctcatgacaaatccaggtcgaagcggtcaaggtccagatcaagatccccccacaggcgccatcgtaaatgaacactctagcaaactggtctgagactgtacccgggacaatattgtgcgcggtggatcacaggattgggttaatgtactggacggacatcgatataatcaaaaactataaagtcaccggtttgtgagcgaaatagtgcatagtaaaccgctctttccttagttcttcagaagaaatatccaaagatttttgactgacttgtttgacaatatcgttggttggttaagcgttcctatgtaaaattttgttccctctgaaaaaa

SEQ ID NO: 18 - DNA, 442 bp, Arabidopsis thaliana
ttttttttaataataatattatattattattgatattcgaatgagtcaaattcaacagcgatacataatagagagataaaagacatcaaacataaccaacatgaaatcaactagaactcaaaacaagaccagacttaaacatcatcaattagttgattttactttaaattcatttaaacataaaaagcaaagaagaaacttcttaaaagaagaatccaaaggccatcaccgctacggaggcgaagaaagtagggataaatgaggaagcatcggaggtagggctaggcgcgggagcgtcaaccgctgcaaccgtctggtgaactgtagagaacgctatcactgccaccaaaaccgccacgaaaagcttcatcttcattgcctccattgttagtaaatgaagagaagaaaagaggttttggtgcttactgttgtgttgttggtt

SEQ ID NO: 19 - DNA, 813 bp, Arabidopsis thaliana
ttaacaaatagtcataacaataaaatatataaaaaataataatattaataacaataataataatgataatgggagaaagaaatccctaaaaaaaaattgaaaatgggagaaagaaaaccaagaaggttttgtttcatctcctttcttcccataagcctttttcttgtattgttcccttctcttctctaaataaaaaaaaaaaaaactgttttttgtgaaaattaattgaccaaaaacaaagaaatcttctttcttctcttctcttctttgttaatcttgttacccttctaccaccaccacctgtaaaaaagaggtttttatctaccacatagagagaccagacaagaacatgtgattctttggttaggtctctcaattctgctgagccacaagctgatcgagctgcatttgctcaatccaagcttctagcccagcatgatccattaccggttcaaccggatttggctgcttcatcacgtgttcccctgaggaagatgttgctgctttctctttggcttctgctggagtctccttcaccagtgactggacccatgacacatcaggctcatcaccatcaaacgatgacgaagatctcaacttaccaagtgcttctgagctcattccccaatccggttgaccatttgaagatccccattttgatgaccatgtgttgttgtttaccggtgaaccaacgattgggctagagtttgttctgagctctctggagctaaggctacggaactgatgttgctgctgctgctgctgctgttgctgttgttgttgcttcacgcactgagccaacatggaaacccg

SEQ ID NO: 20 - DNA, 397 bp, Arabidopsis thaliana; identical to SEQ ID NO: 17

SEQ ID NO: 21 - DNA, 625 bp, Arabidopsis thaliana
tatgtgagagatatagtaactacaactgaatgaaaaatccatgagacaaaaaagttcgcaatagaagaatattgattcggtaacaaagcacagcttataagttttcttgtgttaaagatgaaccaatttgaagcattagaggataaactggactaaactctttgtcccctctcgatctgatcttcactgcataatcatccaaagttgcttttatccctttccagatctgatcctctctttggttatcaagccacagtgagtactgtttaggacttagtctgttcttctgcatcggtgactctaactcgtctgggcctcttgtgtagagatgatgtaggacgatgctcggtggtagatcattgatgagaggagatgatcccatttgagatgtttccaggaaaaccaaaggcctaaacgctctaagagctctgtacggtgctccgagttgttccacgggaaatagattctgtcccactgctagttccagctcggccatgtctttggccattctgagttttccccattctgaaagtggtcgcacaagggatgcatgtctgatgtagaagatcaaaacccttgacgccatttgtcttgtgagtcttgtgcagatcgattctgttcctgc

SEQ ID NO: 22 - DNA, 959 bp, Arabidopsis thaliana
agaaacgatgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatagcgtaaaaggctaaaactccacccactagatatcggatcgtatcttataaaccatataatatacgaatacgattaataatatatcaaaaagattggaaataggtgtgctttttgaaattagtgagcgttttttatggaaaagaaaagaaaagaaagcagttggcgtctggataaagggaaggaggagaatctttagattttttctttaatctgtttttcttttgtcttgattagttttttctttagtggtggtggttgtgagttagtgtgtaaaatgtatattgtcatatgtgaatttaataataagtccttttgtaagatgatcaaggggaaaaaaaaaaaaa

SEQ ID NO: 23 - DNA, 700 bp, Arabidopsis thaliana
ctggatcttgctaaggttcttttagagatgttgacggccaacaaaatggccaaagcattttttacaagcggtggatcagatgccaacgatacccaggtcaagctggtttggtattacaataacgcacttggaaggcccgagaagaaaaagtttatcgcgagaaagaaatcgtaccatggctccactctaatatcagcaagtttgtccggccttcccccgctacaccaaaattttgatttacctgcaccatttgtgttgcacacagattgccctcattattggcgttttcatcttccaggcgaaacggaagaggagttctcaaccagattagccaagaatttagaggatctaatcatcaaagaaggaccagaaactattggtgcttttatagctgaaccagtcatgggtgctgggggtgtgatacctccacctgctacctactttgaaaaggttcaagctgttgttaagaaatatgatatcttgttcattgctgatgaggtgatatgtgcatttggaaggctcgggacaatgtttggctgtgacaaatacaacattaagccagatcttgtgaccttagctaaggcactgtcttcagcatatatgccgattggagccattcttatgagccaagaagtggcagatgtcataaattctcatagcagcaagctaggcgttttctcccatggatttacttattctg

SEQ ID NO: 24 - DNA, 618 bp, Arabidopsis thaliana
ctttcatgtgagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcacaactgactaaagacggtgaaacgtgtgagatcccggtttgaaggttaatgaaacaggctttgcttactctcttctgtcagtctcttttagctccttgtaatcctctgtgtctctgtctgtttctccatattacctgtaatcaaagctatctgctaaacctacgacatggttaaataaatgcattgagacttagtaaaaa

SEQ ID NO: 25 - DNA, 1094 bp, Arabidopsis thaliana
atcttatgcaagaagttgctgtggagacatttggtgctatggcaaaaactgagaaaattgcatttatccttgaacaagttcgcttgtgcttggatcgtcaagattttgttcgtgcacaaatcttatctaggaagatcaatcctagagtttttgacgcagatacaaaaaaagataagaagaaacctaaggaaggtgataacatggtagaagaggctcctgctgatataccaacccttttggagcttaagcgaatttactacgagcttatgattcggtactattctcataacaatgagtacattgaaatctgccgtagctacaaggcgatatatgatatcccttcagtaaaagaaactccggagcagtggattccggtcctgaggaagatctgctggttcttggtcttggcacctcatgacccaatgcaatcaagcttgctcaatgcaactctggaagacaagaatttatcagaaatccctgatttcaagatgcttctaaaacaggtagtgacaatggaggttattcaatggacatctctgtggaacaaatacaaggatgagttcgagaaagagaaaagcatgattggaggttctttgggtgacaaagctggtgaagatctgaaactgagaatcatcgaacataatatcctcgttgtctcaaagtactacgcaaggataaccttaaagagacttgccgagcttttatgcctgagcatggaggaggcggagaagcatctatcggagatggtagtgtcaaaagcactgattgcaaaaatagacagaccatctggaattgtgtgcttccagatcgcaaaggacagcaacgagattctaaactcgtgggcagggaatttggagaagcttctagatcttgtggaaaagagttgccaccaaattcacaaggaaaccatggttcacaaagccgctctcagaccttgaaaacatgcggtcttcttcatgaaaacttttcaggatcttcttcgttgagttattagcatctttatgtggtaaaaactcgaatcagtgtttccttttaaaaattgtactatggatctgtacactaacgaagtgttttgccacttattggttaaaaaa

SEQ ID NO: 26 - DNA, 367 bp, Arabidopsis thaliana
ttttgaaacataaacaaaactcttatttattaaggacttgtgctaaatacatttagcctcaaacatccaaaacttacattttcataaaagacacgatgaggtgtggtgttaacatgtatcaacaaccacactctcatacgctcgagggtttttgtttggaatctattagtaaggagggaagaaagggatggtggtctggaaggggcattcaccaacttgctggatcttgcaaatgttaggcaagtacttagctgtcttgtaaattttcctggattggaatggtccgtgttgtccctggaggctaacggccctggcagcttgtctcaaggtggggcaaacacaaactggctcttcctggcgaagctcg

SEQ ID NO: 27 - DNA, 949 bp, Arabidopsis thaliana
ctaatggaaataccgaggcgaatgtagtggaagctgtagagaatgtaaagaaggataagaagaagaagaagaacaaggaaacaaaggtggaggtaactgaggaagagaaggtcaaagagactgatgctgtgattgaagatggagttaaggagaagaagaagaagaaggaaactaaggtgaaagtaaccgaggaggagaaggtcaaagagactgatgctgtgattgaagatggagttaaggagaaaaagaagaagaagagcaagtcgaaatctgttgaggctgatgatgataaggagaaagtttcaaagaaaaggaaaagatcagagcctgaagagactaaagaagagactgaggatgatgatgaagaatcaaaacgtaggaagaaggaagagaatgtagttgaaaacgatgagggtgttcaagagacacctgttaaggagactgaaactaaggaaaacggaaatgctgagaaaagtgagacaaagtcaacaaatcagaagtcaggaaaagggctttctaactcaaaagagccgaagaaaccgtttcagagggtgaacgttgacgaaattgtgtacactgagaatagcaactcgtactattcaaagggtggtgctgaaattggctatggtcttaaagctcaagaggttctcgggcaagtgagaggaagggatttccgacatgagaagacgaagaagaaacgaggaagctacagaggaggattgatcgatcaagagtcacattcgactaagtttaataactcagacgacgaagaatgattgataagcagacaacactgcctttttgacattgcttcgtttcgatttatctttttcttttcttttgctttgatcatttcaatacccgtaatagggctcaagttttgtgtctgtgcactcctttgatacttatatgaacatgattcagtttcagtttcttgttcaaaaaaaaa

SEQ ID NO: 28 - DNA, 711 bp, Arabidopsis thaliana
ttttttttttctctcgcaaacagaaatttatattgacttttaagaacaaatacaaagtatatctatcacacaactcacaaaagagataggtacaaacataatgacaaatcacaatcagcacaccattacattaaaagtcaaatttacctttttaataagaagatacaaaaatatataaagagaagaccaagacaatttgacttgagtgattaggaggcattgttggcctgtaataatccatttcgaatctgcgttgccacgtcagcgacggcgcctggaccgtgagggataaacaccgccgaggctttagaagttgctccgatatctctcattgtgtcaaagtactgagtcatcatcaccatgtccaacacatccttcgctgacgtccctggcacgtttcctgcgaaccctagaacactgtctctcagaccgtccacgatcgcttgtctctgccgagcgattccgagtcccgacaggtactttgactctgcttcaccctctgctcttttgatctgaatgattttctcagcctctgctttttcgctcgctgccactctcatcctcgccgcggcgttgatttcgttcatggcacgtttaacctgttgatcaggctcaatgtcgataattagggtttgaaggatttcgtaaccataagcagtcatggctttgtctagctcttcttccacagatttggcaatttcattcttctgc

SEQ ID NO: 29 - DNA, 1132 bp, Arabidopsis thaliana
gaacatcagaaaaaggcatgtaatattaattcagccaacatctgtggatatgcaggtgttgaagagaaacggtacaaattaaagttgatttcttttactttgttacagctacgtaccatacaatcacccaaacatacaaaaccttaaaagacaaaagttggcatctctatcagttgggttctagtcaatcttcactgaggagtagatctttctcacgaaccagaagcaagcatagaaaccgattgtgccagttaggacgaagaatgcgtaagagatgataatcatgtacccgaagtagagcattcccgagactagctttgtgatctccagctttgtgaagaagtagaagattgagtagaggaagaggtagaaagcggatgagcccgcagttaagtaagctctccaccaccagttgtagtcttcgctacaaagctggaagtagcagagcaccactgtgatctctgcacaggtgacgatcaagatcaaaaaaactataaagaggaacccgaagatgtagtagaactggttcagccatatagatgtcaagatgaagaagagctcgatgaagactgctccaaacgggagaatgcctccaattagtatagagaaaactggtttcatgtaccacggctgctctggtacttgcctcgggatcttgtttgttttgactggatcttcaattgctggcttcttgtaacccagatagctaccaacgaagactagtgggactgagatgccaaaccagaggcagaagagagcaaacattgtaccaaatggtatggctccagatgactgttctccccaaataagggcattcagaacaaagaagatagcaaaaaggataccgggaaacatgaatgcagtcttcaaggtcattctcttccacttgtttcctttgaacattttgtgaaggcgagacgaggagtaaccagcgaatatgcccatgaaaacccacaagagaaccatggcagtcataagccctcctctgttggatggagataagaagccaagcaacgcaaacatcattgtaacaagtgacattccgaagatctgaacacctgtaccaacataaacacacaataaaccagagttcaccggtggcctgaagacatctccgtgtacaagcttccat

SEQ ID NO: 30 - DNA, 389 bp, Arabidopsis thaliana
agtgaagcaatggagtccagatggagtgactcggattggtgtgattgggaaatcggtatattccgtgaaattctccggtatatctacccggaagatgctccaccaaccgtcgtctgcttgcggacgcgtgggtcgacccgggaattccggaccggtacctgcagaggaagatgaagatttaagttgggacattgatgaagatgacgaagaagaatcatcatcatccaaagcttaatgttagttttaaagtggtgtgctttcttacttttgccaatccttttacttgtttttacaagtttctggcgctttgcccccattcttcagttgtttctctcttcaacgtttctattttacattgatttgaaaatatgtttttaaattttaaaaaa

SEQ ID NO: 31 - DNA, 711 bp, Arabidopsis thaliana
gaagaagaagaagtaatggcttcctctatgctctcctctgccgctgtggttacctccccggctcaagccaccatggtcgctccattcactggtttgaagtcatccgcttctttcccggtcacccgcaaggccaacaacgacattacttccatcacaagcaatgggggaagagttagctgcatgaaggtgtggccaccaatcggaaagaagaagtttgagactctatcttacctccctgaccttactgacgtcgaattggctaaggaagttgactaccttctccgcaacaagtggattccttgtgttgaattcgagttggagcacggatttgtgtaccgtgagcacggaaacactcccggatactacgatggacggtactggacaatgtggaagcttccattgttcggatgcaccgactctgctcaagtattgaaggaagttgaagaatgcaagaaggagtacccgggcgccttcattaggatcatcggattcgacaacacccgtcaagtccagtgcatcagtttcattgcctacaagcccccaagcttcactgatgcttaaatccttttctggaatattcaatgttgactatccggaacccaattttgtatggtcaatgtaaatttaagtaattattttgccaaagtgaaaaaactgaaggtttgtttttctatcatttcctctataaaaatctctattcatatcacttca

SEQ ID NO: 32 - DNA, 607 bp, Arabidopsis thaliana
agcaacctttctctgaattcggggaaatagtgtctgtcaagattcctgttggtaaaggatgcggatttgttcagtttgttaacagaccaaatgcagaggaggctttggaaaaactcaatgggactgtaattggcaaacaaacagtccggctttcttggggccgtaatccagccaataagcagcctagagataagtatggaaaccaatgggttgatccgtactatggaggacagttttacaatgggtatggatacatggtacctcaacctgacccgagaatgtatcctgctgcaccttactatccaatgtacggtggtcatcagcaacaagttagctgaggaaactaaaagcttaatctgagcatctatctataggacaacaaaaactcactcaggttaggtgatgttaggaggtataaggcaaaagtggttggcttcttgtctctacttgagtttagggtttatcatcttttggacatcgaattttggtggaaatcatacagtaatttaggagacttggatttgattgattaatttgatttgtttcttctgatctttttgactattgaacttattgatcaaagaagtgagttgcaccaaaaaaaaaa

SEQ ID NO: 33 - DNA, 874 bp, Arabidopsis thaliana
gtacaatgtctcctatgtctaccatgccctagatgcctacatcgagagagacaatgtcggcttgaaaggtttcaccaagtcagtttctttagtctaaaggaaaaccgtatttgtgtctcttcagctggtggatcatctttttgttattgttgagggtttaacgctaataggttctttaacgattcaagtcttgaagaacgaggttatgctgagaagtttatggagtatcagatgcattgtttgcgatggagcttgcactgactttggagaaacttattaatgaaaagcttctgaagttacaaagtgttggtgtgaagaacaatgatgttaagctggttgattttgtagaatctgagtttctaggcgagctggtcgaagccatcaagaaaatctcagagtacatagatggaacaaaaataaggtcaatgcagtggtgaagctgagatcggatgtttctgatataagctggcaagtgaagatggagggtcaaagactaacccaaggctggcaaaagttcgcaacaagccacgatctccgagtcgtcgacatagttgttttcagacatgatggagatttcttctcaaaactttgaattctttgaattctttgtttcgagatctatcgatactcgacatcaaagaactccttataactcttgattcattgaaacaagagtaggcatgtcaatcgagctatcccggtccgacccgaaacccgtaatacccgtatatgtttgagtttgggtcagaaaagctctgagcctatattttaatttaggtatttcctgtattttttattttttgtattcaatttctccaaaattagtggaaattatccatattttctttctatttttttaaaaaaaaaaaaaaaa

SEQ ID NO: 34 - DNA, 874 bp, Arabidopsis thaliana; identical to SEQ ID NO: 33

SEQ ID NO: 35 - DNA, 582 bp, Arabidopsis thaliana
aaaagaagcttcatgtatctgatgaagattttgccaagtggaagtttgcgttcatgtcaatggggcgtccagagtacttgcaggacacagatgttgtttataatcgcttccagagaagagatgtctatggtgcttttgagcagtacctcgggttggagcatgctgacactactcctaagagggcttatgctgcaaaccagaaccgccatgcttacgagaagccggtaaaaatatacaattagccccaaaacatgaacacaaatgtcaggagacattgtggcagcaacgttggaccaaggcattgattggaccaatgcatcgaataagaagggaaagggcgagtgtgagggtgtgatgatgaccgtaggatgttgtagagaatctggtctgatagggttttgggttgcgcattgatagtggtgtgttttctatttttttcttttcaatctatccttattttatttcgtgcttcaatactttgtgttaatatctggaatgtgtgaagaccattgcacatgcaatttttattttccaaaaaaagaatatggaagcccttcgcttggaaaaaaaaaaaaaaaaaaa

SEQ ID NO: 36 - DNA, 938 bp, Arabidopsis thaliana
agttattaagcttttaaattttataaataattaattattatcttaactaatcttgatcttttttattttttatttttttggttagctggaaaataaattgtcggcaattacagatcaaaatgaggcggagaaatatgtagatgtgattgacccaagggatattaagattgggagcagaaaattttatagatacattggatcacttactactcctccttgtacgcaaaatgttatttggaccgtcgttaaaaaggtaaatactcatcgttattttcttctcttttttacttaatcaaacatagcattaatagatcattacaaggtactaatagtgtgaatatccatatccaaaaggtttatccatctacatgttaactaggtctatttttccaattttaaattttgactttttattttaaaatcattcgtttaaatttatttggttggttttttaggtaaggactgtgacgaaaaaccaagtgaagctactcagagtggcggttcacgatgtaagttttacttaaataatttacttagtgaatttcacaactatactatatcttagaagttgaatgtatattatatttgtttattatcaaaaatgtaaatatgattgaaaaataaatttgcagaattcagatacaaatgcgagaccagttcaacctacaaataagcgcgtggtaaagttatacaaaccaaaatcactatgaatcaaggcgtcacatgaatcaaatacaattaatttatttcaattttttacaaccacagtgtactatttatttaatttttttgttcaccaaagtttttatatataacacgaaaaatatatgatgtatgtgttttcctgagtatcctatggtgtcccatcttcctcctgtagtttcaagatcttcaatccaatctaattcaaatataaaaaaaaaaaaaaaaaaaaaaaa

SEQ ID NO: 37 - DNA, 787 bp, Arabidopsis thaliana
gaagaatccgaatccaattcaatgagtcttcttcgtcttctcctcgttgttgttgttcttcatctttctgcggtggccggcgacgacgccatcgtctccagattccaggagtacctccgaatcaacacggttcagcccaacccggaatactacaaagccgttgactttataatatctcaggcgaaaccactgtccctcgaatctcagacgatcgaatttgtaaaaggaaagccgcttctcctcctcaaatgggttggctccgacccaaccctacctgcctttctcctcaactcccacaccgatgtcgttcccttcgaggactccaagtggactcaccatccgctccaagctcacatggaccaccatggcgacatctatgccaggggttcccaggacatgaagtgcgtcgggatgcagtacctcgaggccatacgcaagctccaggcttctggcttcaagccactccgatccgtctatctctccttcgtccccgatgaagagattggcggccacgatggcgcagagaagtttgctgaatcccaattattcaagagcttgaacatcgcaatcgtgctcgacgaaggcctgccatcgcctactgagagttacagagtattctatggagagaggagtccctggtggctggtgattaaggctaaaggtccacctggccacggtgccaagctctatgacaactctgccatggagaatctgctcaaaagcattgagagtattcgcagattcagagcttctcagttcgatcttctcaaagctggtgggatagctg

SEQ ID NO: 38 - DNA, 1386 bp, Arabidopsis thaliana
gattctctctctagcgatgtcgatcaaaccggagaattctccgattccgttgattgggattaataatacgtgtgaaatcatggtgtctttgagttcatgaagaacggaggttaacctaatcgaagatttgatttgggactgcgaatgagagagaagacgttgaaggctcaaattggagatttctatgaatttgttgatttgagagaagaattgaggctcattcgtaacggagggaaggtgacggtgacggcgatggtgaatttatagttgtacacggagctggaactcatcaaggacaaagaaggcaaagctactcatctacttaagttctgctccaaagctgaaatacggagattcagatcctttgttcccatgaatcaactacagacgctttaataatctgagggaatcttccgtgccaatatggagagatcatcatcatcatcatcatcatcatcatcaacatcatcatcatcatcattatcatcatcatcatcatcgtcatcgtcatcgtcatcatcatcgtcatgtgatcaggtaatattgactggatcagcaaattcgccgacgaattagagtggaacctcagagggaattttttttttacgatttgtctaatctgattcgaaattttgtctcgtggtgatgccgatgaaatagaagatgtgtacctttcatatcattcactctggttttatgggatcagaagaaattagcgagagtaaaatctgtggacctgcaccatgtaacttgattatggcactcagtccgagtaaggttctgacacatgttatctcattctatgtttacatgcttgttcatcttcaggtttggaatcttggtttaccttacccaacttttacattggccattgacgataagccctatctaaataccgtctctgatgatcactctgttaaggtcaaaaatgttgattggatcagcaaactccctgacgatgtattgctcataatattatcgagactttccacagaagaagccataaggacgagtgttgtgtcgaagcgatgggaacatgtgtggagtcaaatgtctcatctcgtcttggacatgcggaagaagattatcaattccaacaacacgcctgatggttcgaatccagttgctacattgattactcaggttataaacaatcatcgtggacatctagagagctgcgtgatcatgcatgtcccatatcaaggtggaaatggaatgctcaattcttggattcgattactgagttgcatgaaacgcacgaaagttctcacacttagaaccattatgatacttgggatcgaaagttcaaaacttttaacttttctcccgactccttgtcccatccaagtcttatgtcactctcgctacattcatactttctcgaaa

SEQ ID NO: 39 - DNA, 719 bp, Arabidopsis thaliana
caatagtcatggctagaaaccttgaagaggaatcaagtggtgatacagagttcattaaagcctcttgtgagacgacgtcgtacccagaccgatgcttccagtctctgtcttcatatgcaagcgagatcaagaagcagccacgtaagcttgctgagaccgcgcttgccgttagcatagcccgagcaaagtcagccaaaacctatgtatcagagatgactgattataaaggaatcacaaagaggcagcacgaggctgtagcggactgtctagaggagatgggagacactgttgacaggttgagcaattcgctgaaggaactgaagcatctggaggaaggtgacagcggagaagacttttggttctgtctgagcaatgtccggacgtggacaagcgcagcactgacagatgagaccgcgtgtatggatgggtttggagggaaggccatggctggggagctgaaaagtttaatcagaacacacattgtgagtgttgcggaagagacgagcaatgccttggctttgatcaatgactttgcttccaagcattgaaatcatttcaaaggggtttagtctttgggacaagagtttttctcgtattcaacactgcttgtgtttttttttctctctttaaagtttctactttatcttaacttatcatttttcatattatgcataaattaatctgtattaaaattaaaatacttcataattcatttcaaa

SEQ ID NO: 40 - DNA, 808 bp, Arabidopsis thaliana
caaagaagaagatttccagagatacgatgagtcgtctgattcaacattctacgaagctccaaggtttgtgacacacattgatgatccagctatagctgcattgacaaagtattactccaaggttttgcctcagagcgatactccaggagtgagcatactcgatatgtgtagcagttgggtcagtcattatccaccggggtataggcaagaacgaatagttggaatgggtatgaatgaagaagagcttaagcgaaatccggttctcaccgagtacatagtccaagacttaaatctcaattcaaatctgccttttgaagacaattctttccaagttataaccaatgtggtaagtgtggattatcttacaaagccgcttgaagtgttcaaggaaatgaacagaatccttaagcccggaggactcgctctaatgagcttctcgaaccgttgcttctttactaaagcaatctcgatatggacatcaactggcgacgcagatcatgctctcattgttggatcatactttcactacgccggaggatttgaagctcctcaggccgttgatatatctccaaatccagggcgttcagatcctatgtacgttgtttactctagaaaactccccatggtttaaacctgagatccaagcacatcatgtatacacatagtagagaccgaggaaactaattcttcgattaagacaagggaacttctgaaatcttgtttataaagaatgtgccactctctcaacactaataacaatgtcatataaagaatctgaagccagattcgcaaatttgacgataaaaaa

SEQ ID NO: 41 - DNA, 626 bp, Arabidopsis thaliana
tttttttggaagaaagtgtaaatacttgaaacttttcaatctaaaggttttcacagttgatgtgatctcaaataacaaaaaaaggtaatacgaactcataaactgttgttcaaaaagggaaccagagaaacattgtcaatctaattcagtttagatgaagaggctgcaaaacccgaactcaatcttgtgtgtcgtttcaccatcctcctttgcagctgaagttccctcagaatatgtgcatcaagtcataagcaaatgtccagaacagcacaaacgacataaggccaccaagaaagccgtcaaaaaggacccgattccacgaatcaaagtacaagtcagctgagaatcctgccttagccatgagcccaacagatgtgatcaacatcaccacaaagtaaaatacaaaaccaatcaagccattgaatccaattattcctgctaagacaccagctatgatagacagaaacgtccggctgttttgaatgactttcaaattgttctgcaaattctctgcactgaaagttggtatgtcactcatgatatcctttgatctcttctcagatgaacccatttaagatagcaacaataattagaaacgagagtagtaagaggaagatcgaagtagc

SEQ ID NO: 42 - DNA, 261 bp, Arabidopsis thaliana
tttttttttttttttccaaaaaggttcaaaatcataacacaaaacaaaagaaataaacaggaagctcgagtgccaagtacctccgccacctccgatcaagaacccaattccgagaattgagctccgacggagaataaacgaagcggtaacacaaacaaccaaccaaataccaaactactaaagtaaagaaactaaaatagtccttcatttcatcagcggaaagagttttgatgttcagagttcacttggcacccttcttga

SEQ ID NO: 43 - DNA, 725 bp, Arabidopsis thaliana
gatatgagtagccaaatcgctttgtcaccggccatcgccgccgccattcgccgtccgtcctctcacgactgtctatccgcttccgccactactgctaccgccacccccatggctctcaaatcttgcatcgtcgcacctctctcgctattcacctctcaatctcaaatcaaacactcaagctcaagaaaaacttctcgaaccacgattcgatgcgatgtagcgataaaatccgcagattcgataaacgcagacgccaatccttcgtcctcaccgtcatcagaggaagaaatcgaagcggaagcgaaggcgaagataggatctagggttagagtaactgcaccgttgaaggtttatcatgtaaatcgagttccagaggttgatttagaaggtatggaaggtaaactcaaagattacgttgctgtttggaaagggaaacgaatctcagctaatcttccttataagattgagttcttcaaagaaattgaaggtcgtggtcttgttaaatttgtttcacatcttaaggaagatgagttcgagttcattgatcagtgatgaaacaagaaagacaatttttgttttcctttctcagtgtttgtttttgtttgttgtgtttactggaacctgggaatggagaatgatttgtatgtagtgtgatgtgtattcaacctttagcaatcatatacataagggtttcttcaaaaaaaaaaaaaaaaaaaaaaaaaaaa

SEQ ID NO: 44 - DNA, 983 bp, Arabidopsis thaliana
tctttcttcttcctgattggaattttagggcttttgaaagcacgaacgcgtgaagctctaatcgagaaaaaaatggaggttttggataggagagacgatgagatcagggactcgggaaacatggacagcatcaagtcacactatgttaccgactctgtttccgaggaacgccgctctcgtgagctcaaggatggtctccatcctttacggtacaagttttcgatatggtacactcgtcgcacaccaggggttcggaaccagtcttatgaagataacatcaagaagatggtagaattcagcacggttgaaggattttgggcctgctactgtcaccttgctcgttcttctctcttgcctagtccaacagatcttcatttctttaaggatgggattcgtccattgtgggaggatggtgccaactgcaatggaggaaagtggatcatacgtttctcaaaagttgtatctgctcgcttctgggaggatctgcttcttgcgttggtaggcgaccagcttgatgatgctgataacatatgtggggcagtactgagtgtccgtttcaacgaggacatcattagtgtatggaatcgcaatgcttctgaccatcaggcagtgatgggtttgagagactcaatcaagcggcatttgaagttgcctcatgcatatgtcatggaatacaagccacacgatgcttctctccgcgacaactcttcctacagaaacacatggctgagaggataggcccaaagtcgatgattgtatcatgtaatgtggagaagatttgggaagctcatctgcaacctgggaagatatctggattgaaccctgtatccaataccatactgtaccggaggcttacaatatcagaaaaacaaaatccgggctacttctgtgtcagtatgtgttcatttcgtttttcttttacagtacatcttgttaacttcaatggtttgactcttgatcaaaactataagggttaattttca

SEQ ID NO: 45 - DNA, 693 bp, Arabidopsis thaliana
aaagacgctgaagaagaactttgccaacaagggtcttaacgctaaagaccttgtggttctctcagggggtcacaccattggaatctctagttgcgctctcgtcaacagtcgtctctacaacttcacaggaaagggcgattctgacccatccatgaaccctagctacgtgagggaattgaagagaaagtgcccgcctacagatttcagaacctcactgaacatggacccaggcagtgcgttgacattcgacactcactacttcaaggtcgtggctcagaagaaagggctcttcacatctgactctacgcttctcgatgacattgagaccaaaaactacgttcagactcaggccattctccctcctgtgttttcttctttcaataaagatttctccgattccatggtcaaacttggtttcgtccaaattcttaccggcaaaaatggtgagatcaggaagagatgcgccttccctaactaatttggatcgatcagaccgggtttcggatgattttgagtctacacgtttttctctgcttattttctttctttttcttttttctttcacggaagtttgagctttggtgttgtcttcttctgtttcttccatgaataattgttttttgttgagtaactttacatttgtattctttacggtgactgtgttttgtaatggaaaaagtttgtttcgaattc

SEQ ID NO: 46 - DNA, 604 bp, Arabidopsis thaliana
tgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggaatatacaaatcaatccaagtggtcttggtacgggagagggaaaagctttgtcgatgtatcttggccttaatgtgaatgagatattcagaccatatgagaagatttatgttcgagccaagcttcgagctcttaaccaactcaatctcagtaacatcgaaagggaactcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctccatgtgtttgatttgttatcaaatactaataagaatttgattatgcatttcaaatacaattgtttctttttcttaaaaaaa

SEQ ID NO: 47 - DNA, 154 bp, Arabidopsis thaliana
ttttttttgttataagaaagaccgattgatttatatgtaacaccaaaacaacatagagaaaaccaaaaggaacaagcaagagcttcccacggcagacattctagaaggatgatttactcaaagatatcatcatcgtcatcggggaggggttgag

SEQ ID NO: 48 - DNA, 162 bp, Arabidopsis thaliana
gaagaagcagctgaagctgctaaatctgcttgaaaaaacccgctattgatttatggtctcttccttgttgtttcctcgagatgttgttaatctctgttatttgttgctgaaccatcttgtatttgtttttcttttggtgtaaacactttccttatcaagtaa

SEQ ID NO: 49 - DNA, 225 bp, Arabidopsis thaliana
ttttttaaaatttaaaaacatattttcaaatcaatgtaaaatagaaacgttgaagagagaaacaactgaagaatgggggcaaagcgccagaaacttgtaaaaacaagtaaaaggattggcaaaagtaagaaagcacaccactttaaaactaacattaagctttggatgatgatgattcttcttcgtcatcttcatcaatgtcccaacttaaatcttcatcttcct

SEQ ID NO: 50 - DNA, 1261 bp, Arabidopsis thaliana
tgaaaccggaaatgtagtaacttgacataagtttttcaatccgacaataaaagtgatccgagttcgaatctatcaaaaaccaaacgacaaaaactaatcacgacgacatagcgttgttgactacaaacagttacaacatcctactttgatagagattgtggatccactcttatcactcgtcagctggtggcgaacgaggagaccggctcttctgcattgggctctctgcaccatcatacccaccatcactgtctcttcttcctattgacccagggctttcaacttggccattctcggggctagacctcgatctctctctcctttcaatgggactttcaacttcaccaaccccatttctcggactctccttcttgaacgggctgtgattagggctcatcctctctctcttgttgttgggactgcggctgtacttagtagggcttgcgactctctccctcctgcgagggctatcattgcctctgcggtcacgaccatactcgggactgccacgtcttgatttcttgtaaggacttgggctacgtcttcgaccatagtcaggactggtcctttcctttctgtaggcagcaacaggactagctcctcggccataatcagggcttcctctttctcttttgtaaggactaggtgatcgccttctcctttcaggtgacctatcacggcgtctttcaggactgtgtccatttcctctagcatcatcatccttcacagcatactccaccgagatcaccttatccatcagcttactgttatttgaagcatccaatgctctggtggcatcctcttgtgcctcgtactggataaatgcaaaattcctcctgatcctaacgtttacgatctttccatacggctcaaagtgtttctctagatcccgggtcctagtattatccgcatcaaagttaatcacaaagagagtcttggaaggtctcatgctggatgaggatctccttgaaccaccaccagatcttttatcacctccacgttcactctttgtccattcaacacgaagtctgcgtcccttacgcccaaattcaaagcggtcaagtgctcggatggcatcttccgcatccctttcatcttccatgtatacaaaagcaaacccagctttcatatcaaccctctcaaccttgccgtatttcctgaatagtcgttccaggtcaccttcgcgcgcatcatactcaaagttcccacagaagactggcttcatgcttcctgtagaatgattttggcaggcgtagtcgcg

SEQ ID NO: 51 - DNA, 745 bp, Arabidopsis thaliana
acgataactccgccgtctcccgccgtcttgctctcactctcctcgtcggcgcctgctgttggttccaaagtatctcctgctgatgccgcctacggtgaagctgcaaacgtgtttgggaagccaaagacgaacacagacttcttgccatacaatggagatgggttcaaagtgcaggttccagcaaaatggaacccaagcaaagagattgagtatccaggacaagtccttaggttcgaagacaacttcgatgctactagcaatctcaatgtcatggtcactcctaccgacaagaagtccatcactgattacggttctcccgaagagttcctctctcaggttaattacctcctagggaaacaagcttacttcggtgagactgcctctgagggaggctttgacaacaatgcagtggcaacagcaaacattctggagtcatcatctcaggaagttggtgggaaaccctactattacttgtctgtgttgacaagaacggctgatggagacgaaggtgggaagcatcagctgatcacagcaaccgtgaatggagggaagctttacatctgcaaagcacaagctggagacaagaggtggttcaagggagccaggaaatttgtcgagagcgcagccacttctttcagtgttgcttgagtgaaagcaacacaacgtaacaatgctctgcttgctttcttcatttgtctcttgtaaaaaatggaaaatgaaactgagcttttgagaaaaaaaaaaa

SEQ ID NO: 52 - DNA, 725 bp, Arabidopsis thaliana; identical to SEQ ID NO: 43

SEQ ID NO: 53 - DNA, 725 bp, Arabidopsis thaliana; identical to SEQ ID NO: 43

SEQ ID NO: 54 - DNA, 724 bp, Arabidopsis thaliana
agtaaacgagcaaaagaagaagagaaacaacaagaagtagtaatggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttacctccctgaccttagtgacgtcgaattggctaaggaagttgactaccttctccgcaacaagtggattccttgtgttgaattcgagttagagcacggatttgtgtaccgtgagcacggaaacactcccggatactacgatggacggtactggacaatgtggaagcttccattgttcggatgcaccgactccgctcaagtgttgaaggaagttgaagaatgcaagaaggagtacccgggcgccttcattaggatcatcggattcgacaacacccgtcaagtccaatgcatcagtttcattgcctacaagcccccaagcttcaccgaagcttaatttcttttctaaaacattcttatgaattatctctgctcatttcatttcctattgtctgtgttctttttctctttatgagacaatttctatcggattgtcaaatgtctgatttatgaatatgtaatttatataaaaa

SEQ ID NO: 55 - DNA, 416 bp, Arabidopsis thaliana
agccaggagaatactctcctatgccacatcattcgtctttatcgaccagtatgggaccatcatcgtacgaaggcagagagcggaagagcagtagtatgattcaacacggaggttatcttgaagagccaagcatcagacttcttggaaaagaagcttccagcaaaatggctcgtcgtgatcctgacccaatctatgaccgtgaatgggaagacgacaagaggagagcagaaaggaagcggagagatcggaagtagagagtgatgatttgcagatcctttggtttgttcaacgaagagagagacaaatactggtattgaacactgcttatgttgtacacgtactattcaatgaccgtgcgggtctactttgtcatttggctccgccgagtttgataaatgacttgccagacttcagat

SEQ ID NO: 56 - DNA, 145 bp, Arabidopsis thaliana
aatctttgttgttgtaagatgttataaggatctcaagcacctattattcttaaatattattggttgatgttgctagcaagaaaaattgaatacaaccttaaaaaaaaaaaaaaaaaaaaaaaaaaaaaaaaaaaaaaaaaaaaaa

SEQ ID NO: 57 - DNA, 299 bp, Arabidopsis thaliana
gagatggctgcatcgcataaccggaagcttgttcaacctcccgaaggaactttcttctaatactctcaaagcctacctttgaggggcttctccattgttggtcttcaagcttttctttcgtaccttaaagtaaaaacaatggtgtctgtcgatgaatgatgatgttcgattgatcatctggagtttaaatccttgtgtgcaaatatatctagacaacgctgtctcacgacttcatcttctcagtttagatataatatgggaaacaaccttctagaaaaaaaaaaaaaaaaaaaaaaaaa

SEQ ID NO: 58 - DNA, 450 bp, Arabidopsis thaliana
tttttagagagtcaaattagaatcttgtttcaaataccatcttcaaatgcaagagatagtaagagagctcaaaaggttaaaccaagaaagtaaaatgacattattaaggtcgacgagaatgtacaatcatcaagaggatcagacgtagaagctgaggtaattagcagtagaaagatccaccaaatgtgttctctccactgtatgtcatgtagagaaacccgtcttcgtctttgtgttcttcgtagattgcagacatcaatgccgcagttggtggtaatgtgttcttgacaaagacaaagatggctttttcagctccaagcttgattcttttcctcacaacgtacacaaattggccaatggttagatcagctggtacaagatacttcttcttgtcaatgtcaggaacatcactctgtccagcttttccacaatcacgggaactctttcagg

SEQ ID NO: 59 - DNA, 429 bp, Arabidopsis thaliana
ctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatatttagatacaacaaataagtttg

SEQ ID NO: 60 - DNA, 1012 bp, Arabidopsis thaliana
tttttttgcgtaatgtagtttcctacgttgttgtatctataaatagtttgtttctcgagcttccatttcataattcctcatttcccggatctctcccatctaaaaataacccgacccatttacgcgacccaaaccggatcaacccgcaatggataagccaagcttcgtaatccaatccaaagaagcagaatccgccgcgaaacaactcggcgtttccgtcattcagctcctcccgtcgctagtcaaaccagcacaatcctacgctcgaactccgatttcgaaattcaacgtcgcagtcgtcggactcggatcatcaggtcggatcttcttaggcgtcaatgtcgaattcccaaatctccctctccaccactcaatccacgccgaacagttcctcgtcaccaatctcacactcaacggtgaacgtcacctcaatttcttcgccgtctccgccgcaccatgtggccattgccgtcaattcctccaagaaattcgcgacgcacctgaaatcaaaatccttatcaccgatccaaacaactccgccgattccgattccgccgccgattcagacggattcttacgtctcggaagcttcttgccacacagattcggtcccgacgatcttctcgggaaagatcatcctcttcttctcgaatctcacgataaccatctcaaaatctcagatctggattcgatttgtaacggaaacaccgattcatccgccgatttgaaacaaacggctttagcggcggcgaatagatcgtacgcgccgtatagtttatgtccatcgggagtttcgctggtggattgtgacgggaaagtgtacagaggttggtatatggaatcggcggcgtataatcctagtatgggaccagtacaggcggcgttggttgattatgtggctaatggtggtggaggaggatacgagaggatcgtcggagcggttctggtggagaaagaagatgcggtggtgaggcaagagcacacggcgaggttgttattagagactatatcg

SEQ ID NO: 61 - DNA, 605 bp, Arabidopsis thaliana
caaacatcagaagccctagagcttgagccgtcgaaaatgtcgaagcgaggacgtggaggaacgtctggtaacaaattcaggatgtcacttggtctgcccgttgcagccacagtgaactgtgcagacaacactggtgctaagaacctttacatcatctctgttaaaggaatcaaaggtcgtctcaatcggttaccttctgcttgtgttggtgacatggttatggccactgtcaagaaaggtaaaccagacctcaggaaaaaggttcttcctgctgtgattgttaggcaacgtaagccatggcgccgaaaggacggtgttttcatgtactttgaagataatgctggagtgattgtgaaccctaagggagaaatgaaaggttctgcaattactggacctattgggaaagagtgtgcggatctctggccaaggattgctagtgctgctaacgccattgtctgaagatcatttatcacttttgctggttatgtatctgtcttcaacgaaacgcgaaatagttggtgttttgagtgttttaagtagagacgacaatcttttgtgagcttcagacatatttccagtttctaagagattttgcttagattaaa

SEQ ID NO: 62 - DNA, 915 bp, Arabidopsis thaliana
tttttttttttttccaaccacaacgagatgaattacaccacgactctaagtgaaatcatcttttaaaccaccaaaattcacccaatgacacgaaaacatttctagcacaaagaaaatcaaatcctatcctgagatccaatccaattccaagctattagtccctcatgatccgagtgtagaacatgtcctaatagcatctacgccaaaagcgcaacttcagaagggttttgactcctctgctttcactatttcggtcctaagcctaaaacggacatactaatccgactgatactcaaccggatcaaccgggctgagacaaaaatttcttgaagtcgaggctttattggagagctttccttcttcttctacaatccaaatggttttcttttctcccccatttctcattaattctccatcaggagtcgttgacggcagcatagctaatacgccttgaatcatgtaaatctgcccgggatcgataggatcttcacaaccaagctcgaaaaccacgatccgcctacctctgtaccttcttaacactgagccaccactaccaaggaggttcatcggaggagaggtacctccgcgaagagactgacgaagaaatccaccagatctgctgccgtcgtcgagagtcatagttccccattgtagatctaccaacgaacctccatctgagagaactatctccgctcgccgtcgacttaaaactctttgattaagccacaaagaaggaggagccgccgccggctaaaaaaaatcgacacaaaggaaaaaaaaaactaaaaagagaagagaggccctctcacggtgccggccgaaaccgaccaccaaagaggcaaaacggcgtttgaagatttgatctggtttgcggcggctaactagagagagagaactagggttttttgtttagtt

SEQ ID NO: 63 - DNA, 429 bp, Arabidopsis thaliana; identical to SEQ ID NO: 59

SEQ ID NO: 64 - DNA, 574 bp, Arabidopsis thaliana
ttttttttttttttttttttttttttgaggagaaataattggtaaacttttgcggtacatacggtttgggtcaagttacaaacggataaaccggtatagaatacacagagtttttgaattctcccatttaagctgcaacttcttcgacctcatccaatgcatagttgttggtcgatatgttggcgtaattgacttttgcgaaccggaccacaaccgggtatcgagtcttagggtcctgatcaacggcaacaactgatccaacgttcttgaaccaataggattctctccttagaatcttgaccttagaccctctcttaggaccaatcggtggtggcttgggtttggtggcagtagctccatccggagcagcggcagctgccggagaatcttttgaagaagaggaagccggagcaggatcttcggctgccctgactacgagcctagaaccggcgtttctcatcggcaagaaagacacggagctcctggacgacgaagcgccggcgaccgaggtgacattggccggtagaacaaataccgtagatgctgtcgtcatcgccatctctggttttctttt

SEQ ID NO: 65 - DNA, 780 bp, Arabidopsis thaliana
agttacatcgagtaacgcagcaacatttggggtcggggctattcaggtagtagcgactgcaatatccacttggttggtggacaaagcaggtcgtcggcttctgcttactatctcttcggttgggatgacgattagccttgtaattgttgcagctgctttctatcttaaggaatttgtgtctcctgattcagacatgtacagttggctgagcatattgtcagtagttggagttgtggcaatggttgtctttttctcattgggaatgggaccaataccgtggctcattatgtctgagatccttcctgtgaacataaagggtttagctggaagtattgcaactctagccaattggttcttttcttggttgatcaccatgacagcaaatttgctgttagcctggagcagtggaggaactttcactctgtatggattggtttgtgcattcacagtggtgttcgtgactctatgggttcctgagaccaaaggcaaaactcttgaagaacttcaatccttgttcagatgaacaaattgaaacaacttcattctttgtcaccctctctctccctctctgttttggccaagaacaagaagaaacaagagattttccagctttgttaattgggctgagaacgttactaagatttgtttgtttgttcgttgtgtgtcaataatcgcattatcttctatcacatgtatatcaacatactacattcaagtatttgtaattttattgaactctttacatagagcaaaggttttgccaaaaaaaaaaaaaaaaaa

SEQ ID NO: 66 - DNA, 641 bp, Arabidopsis thaliana
gaacattcagaacaagaactcatcctactttgtggaatggatcccaaacaacgtcaagtccagtgtctgtgatattgcaccaaagggtttgaaaatggcgtctactttcattggtaactcaacctcaatccaggagatgtttaggcgtgtgagcgaacagttcacagctatgttcaggagaaaggctttccttcattggtacacaggagaaggcatggacgagatggagttcactgaagcagagagtaacatgaatgatcttgtcgcagagtaccagcagtaccaagatgctacagccggagaggaagagtacgaggaggaagaagaggagtacgagacttaagatgttgtcaatggctccctcggattcgtaagctgtgtaagcaagcagcattcactttcttctttccccttatcctgaatttttttcttcgtaatatctcttttattgtttcgttcatgtgtgttcgtttttgttattgaaaccctatatcggttctggatttgttaaacttttgcgtgtattgcttattgtttttgtcggtgaaaaaaatattgcttttgttctcttaagttttgtgttgccaaaaaaaaaaaaaaaaaaaaaaaaaaaaaaaaaaaaaaaaaaaaaaaaaaaaaaa

SEQ ID NO: 67 - DNA, 503 bp, Arabidopsis thaliana
ttttttttcagcccaaagaacactttttaattactagtaaagtttaactaacggttaataaacttacatcagacaatattacactttttatcttggctgcttcaatgtctccgcatcgttcgttttaccggtgaaagaagcttcttagctttcctctttcaagcttctcgagaagcttatcggcgcccattacttccatctccgacagcttcttcagataccctattgctccgtacgacaccatcattttcttactcttctcgcttcccgacatccccaacagccccgccacggcgtacttcttcgccgtgtttccagggtttgaatccaataacatcaccaaattcgtcagaacgctcttcccgtctttcttcagttcccgtcgaatccttccttccgctaccaatccagcgatcgcctgagccgccgcttctcgacatccgtttgacttcgattccagaagtttcacgatctccgggatgcaaccggattctcccactagc

SEQ ID NO: 68 - DNA, 503 bp, Arabidopsis thaliana; identical to SEQ ID NO: 67

SEQ ID NO: 69 - DNA, 578 bp, Arabidopsis thaliana
gattcgataagaagaatctacatggctcgacatatcatggagaagttcatcgtcgcaggagcggaaatggaattgaacttatctcataaaacccgacaagagatcttaaccactcaagatctaactcacactgatctcttcaagaacgcattaaacgaagtcatgcaattgatcaagatgaacttggtaagagattactggtcatccatctacttcatcaagttcaaagaagaagaaagctgccacgaggcaatgcataaggaaggatacagtttttcatctccaagactgagttcagttcaaggctctgatgatcctttctatcaagaacatatgtcaaagagttccagatgcagtagtcccggttaaggagtctaaaactggtactagaccagaacccaaaccaatgttcatagcaatccaatccatgtaatcttccttcacatttcttgtacatgtcattttctctcttgttatacctaactgtaagagaaaatgtccggttcggattttggtttagttttaaatgtgtataccggacaaaaactatggaaccatactaattaatatctcgaaga

SEQ ID NO: 70 - DNA, 679 bp, Arabidopsis thaliana
tgggtttttgttttgaactctccttatgtattaccgcctcgccggagactgatacagtttcttctgtccctcattgaaagaagaaaagaaaacaaaaatagaaaaaaaaagaaagcagaaaaaaagcctaggaggaacaatgaatttagaaaaccaaaccatgacagaaaagtctgcgggattctctggttagctctaggtgatgatatgatcaagtttcgtcctcactggctttgtatgaagggaaaagaagataatctaaaagattcgccaaaagacacagatcgttcaccgtgatggctcgcctacaatatcgtggtaaaacaaaaacgattgtactaagtagcaattcctctgtttggttgtctcttgttcacactgtaactgccaacataacctggagatgaacttctagctgaaacatctgaagaaggaacccctcctccaatcccatagctaaaaggagcaggcccttctgtctcaggagttggtgatctccatgtagggtcactataaactgcaccattcccgtaaaactctgcaagtcctgctgtatcataacccgtgttgttggttgctgaggcagaagagaatgaagaggatggtgctgccttgttagcccctgggtttcttgctgcataaccacctgttcccaacccaaaaccagattcaccgtttc

SEQ ID NO: 71 - DNA, 599 bp, Arabidopsis thaliana
ctcggtgaggctgtcggtgttgaagggctggttgtcggtctgcgcgctcagcgccagcagcgcgcgccgcgagaagcaggtaccgacaccggccgacggcaccatgccggaaacactttcgcgcaccaccagatccttggcatgccattcggcgaactcgtccatgtagacgccggccaccagttcgtaccactcgcggtccagcgaggtgaccggcaactggatcatgtccttgcgcggcaaaaggtagttgtagaagcgcagttccatcgggtgcagcacgtcctcgctgtcgtgcaggatcaccccggcgaactcgatgtcgtggcgcttctcgtaatcgaagatggccaggatcagccagttcaggcagtcggccttgctggtcggcccgtcatgcggcacttccacgcggcgcaggcgcttgtagcggcggcgcatgcgctccacttcgtcgatggtctgctggtcgttgggataggtgccgacgaacacgacgtactcgcggtaatcgagtacgttgatcatgttctccaccatctgcgcgatgacgtcgtactccatccacgccggcaccatgatcgccagcggctgttgcg

SEQ ID NO: 72 - DNA, 997 bp, Arabidopsis thaliana
ttgatttaaaaacagttggtggaaagcttactttgtaccaaacgaccctatgcgagagaatctcaggggataacattgatctcgggctagatctcgggtctcaaagctttttgccaacatacaacaaaaatgacatccagctgatatgctgtcaagctgatgcaagtgttttatggcttgtccctgacacagttgtgaccagatttattcaatcccttgactgggacacagatatggacatcacctttacttgggttcttaacagagaccgccctaaaggcaaggagactgtgaaatatgaaagaagtgtcgaccctctggaccttccaaaacgctctgatatccaaatggttctcaatgggtcgatggatggatttagagtgcataatttgtacccaaagttcttccgtgttactggttctggtgatgtcaggtctttcgaggatcagacggatgaagtgagtgcagacatactcattaaccatgcaaatttcaagtggtggtggtcattccataatcttaaagcgtctgaaaatatcagcgcttgcgaggggatggatggaccagttgctatcataatgtctgaggaaacaccgccacagggctttctgggtgacaccctcagcaagttcagtatatggggactctatatcacatttgtactagcggtggggcgtttcatcaggcttcaatgctctgacctgcgtatgagaataccttacgagaacctgccttcgtgtgacagattaatagccatatgcgaggacttgtacgcggctagagcagagggtgagcttggagtagaagaagttctatactggacgcttgtgaagatctatagatccccgcacatgctgctcgagtatacaaagctagactatgatgcttaggtccaaaaccagtctctcacactaaagaaacactttgtcatatttgtacatactgagcggaatattctgagggatttgttttgttttcaatcagcttgtagttgatt

SEQ ID NO: 73 - DNA, 329 bp, Arabidopsis thaliana
acgatgttgatcacaaggggcaagagatggtaacaacagtttgcatgaaatgccacatgctggttatgttgtgtacatcaactcctgtttgtcccaactgcaagttcatgcacccacacgatcacagctctacaaaactgtttaaaccatcaaatttgcttaggcttctatgctaggctctttcaaggttactgaatctataaaatttgtacggcagataataagccaagagactagatatggacaaagttatgtatatactaaaagtaccagaaagtttgtattaattctctgcttctatgaacgatcatgctttagatctctaaaaa

SEQ ID NO: 74 - DNA, 546 bp, Arabidopsis thaliana
cgctcgcgatctagaactaggcttttacgaacagagagcgagccagagagagtgagtaagagagaatgacgagcgtgagtgggtgtggttcagtgagtctgataactaaccgcagtgcgttcttgggaaacggacttcaacaccgtgccgttttccttaaaccatggtcgtcttcttcgcttcagtctcggtccatggttgtcgaagccaaaaccaaaaccagcagcgaagacagaatcgcccgccactctcgtatccgtaagaaggttaatggtacaacggagaggccaaggctatgtgttttccgatcaaacaagcatctttatgttcaagtgattgatgataccaagatgcacaccttagcttcagcttccactaagcagaaaccaatctctgaagagttcgactacacctctggaccaaccattgaggtagcgaagaaagttggggaagtgatagcaaaatcttgcttggagaaaggtatcacaaaggtagcctttgaccgtggtggttacccttaccatggacgtattgaggctcttgctg

SEQ ID NO: 75 - DNA, 678 bp, Arabidopsis thaliana
tttttattaatagttattttattaaattttgaagtactatttttgtcaatacaaaaattctgcaacacattctgcttcaggaagaatgaaatcagtctcccaacaaacaagttctttacgaataccaaggggagtgtcggactgatgttagccaagttgattttttttttcatcaagaaactaaatgctttctctgagtttgacaggaaggtcaagatcaggttccgtgggagtcaaggcacagaagtaatcatcaaccatgtcctctgatactttctccaagctcggtggatcccactttggtgcttcatccttgtctatcaatcgagctcgtactccctcacaaaaattgccggacattggcccgattaatccttgtagcgacattctgtactctcggattaagcattggtcaagtgtttgtaatcttccttcccggatctgttggattcgttttaaagaagagatctcaatgccaccttcaaagataacggtgagctttctttaagtctacgtagagtcgtaatgcaccatgtatcttttcttctactagcctcgatttccaaagaatcaataatttcttctactgtgtcatggctaaagcatttttcaagtaaatcgatcctacgaataacaccagtcttttccggatgggcaacttctgcacatttttctaag

SEQ ID NO: 76 - DNA, 614 bp, Arabidopsis thaliana
agttaaatggtttgggatttaagaaagttttcttcttataacagagttggtaaatttaaaatacaacggaatataatcgaaacaatcagtgaaactatagagatatattgatcacttttcaatttttcatgacccaaaacctctcaatttctccagcggttcttcctgggatcctcccagctatcagttcccacctttcatcaaataataacacacaaaattcagcttttactatggtgttacaattaaattattttcctacgaaatagtattcattattagttaaaagatcaaacctgtcaccgacaagcttatgcattcgagagaccaaatcttcttcttcttgactcatgttcacaacttcccactcaagactactcacttctgttccttgtcatcaccaaaattcagatttctcattatatatagataagtataaaaaaacatggaaaaatgagaaaacgaaggtgtttaagttttcagcttaccttcagaagaagaagtaacgatggagttggtcttgggttgcttagtcctgcgatggttatccatgtcaaacggcaccgtattacaaagaagaagaagaaagaaactaagagagtactctgagagag

SEQ ID NO: 77 - DNA, 578 bp, Arabidopsis thaliana; identical to SEQ ID NO: 69

SEQ ID NO: 78 - DNA, 668 bp, Arabidopsis thaliana
tatagaaattatgcgtacgctacaatcaatggcattacaatgaaccaacctggtattcagattttaccaaatgacaatggacagaaaaaatatacaattttgaacagatcagatgcaaaagttgttctacagacagaaaaagggtaagacttgatgcatcttgttgaggagtttgggaagatgatgatgatgatgatcggtaggagtaggtggatctgagttcttgtctttcttttttctcctaagctggaaaaactgctgcattgtctgagcgcattctgattcaagaactccgcgccggattgtcatcttaggatggaatggatgaactggaggtggtggcttttctgaagcctctgatccatttccttcgcctccagggaacagcctgatccagcttccatctgctccgagaagcttattgggagcaccccatgcaagagtgttgacccttgcttgaagtattgctcccgcacacattgggcacggttctagtgttacatagagcgttgtatccgcgagcctccatgaacgaagtgctttagaaccctctcgaatgcaaatcatttctgcatgggcagttgaatcacgaagctcctctactaggttataaccacgggcaataatctttccatcatgaacaagcacagcaccgacaggtacctccc

SEQ ID NO: 79 - DNA, 682 bp, Arabidopsis thaliana
cttcatcaaatctcacaaatcttcaacacttaatcacaaatctcaaagcttcggataccaaatggctcgtaccaagcaaaccgcaaggaaatccaccggaggaaaagccccaaggaaacaactcgcaacaaaggcggcgaggaaatcagctccggcgaccggaggagtaaagaagccacacagattccgtcctggaactgttgccctaagagaaatcaggaagtatcagaagagcactgagcttctgatccgcaagcttccgttccagcgtttggttcgtgagatcgctcaggatttcaaaacagatctgcgtttccagagcagcgccgtcgcagcacttcaggaagcggctgaagcatacctcgttggattgtttgaagacaccaatctttgcgcgattcatgctaagagagtcactatcatgcctaaggatattcaattggcgaggagaattagaggcgagagggcttaagaaggagattgaagtactctagactgtgatcgttatgcttatgtatatctttcgttttccctaatttcgtgttttagggttggattaggttttgcgtttatgttgttcgatatctaacggatcaaaatctctccttccttagcaaagtttgaaaactccctccacattttcaaaaaaaaaaaaaaaaaaaaaaaaaaaaaaaaaaaaaaa

SEQ ID NO: 80 - DNA, 809 bp, Nicotiana benthamiana
cgagcttcgacttcgagctgtggaaagtctgccgtgccacgtcagcaacaccaagcctcttcaagccgttcagtgtagtgtcggtggacgggaaaacctcatgctcagccgtagacggcggtttggtgatgaacaatccaacagcagctgccgtcacgcacgtgctacacaacaaacgagatttcccgtcagtaaacggcgtagatgacttgcttgtactgtcgttgggaaacggtccgtcgaccatgtcatcatcaccagggaggaaactccgtcgtaacggagactattcaacgtcaagtgtggtggacatagtggttgacggcgtttccgataccgtcgatcagatgctggggaacgctttctgctggaaccgtactgattacgttagaatccaggcgaacggtttgacgagcggcggagcggaggagttgctgaaagagagaggtgtggaaacggcgccgtttggggtaaaacggatactaacggagagtaacggagaaagaatagagggtttcgtgcaacgtcttgttgcgtcaggaaagtcaagtctacctccaagtccttgcaaggaatctgccgttaaccctctcgctgacggccgttaagtttcctttattattataaccctccccgtccgtgatgtaagaagtttgtaaccaaacccctgggttaattttttaaccccagccagcatcttcgagttaattaattagcctttctttttttctaatgactttagttgaggaattaataatggttaatgaatgatagtctttacttatttatccaaaaaaaaaaaaaaaaaa

SEQ ID NO: 81 - DNA, 258 bp, Arabidopsis thaliana
aggccaccaggagtaacttgggatggccttatgagcctttccacgtgcctgaagatgtcaagagccattggagtcgtcatgttcccgagggtgctgctcttgaagctggatggaataccaagtttgctgaatatgagaagaagtacccagaggaagctgcagaactcaaatccattgtcactggtgaactacctgctggctgggagaaagctctgcctacctacacacctgaaagtccagcagatgccaccagaaacc

SEQ ID NO: 82 - DNA, 356 bp, Arabidopsis thaliana
tctccttggaatgtccaagcttgataattctcttgcttatctcttcttctcccgctaggggctctgattcattgtctgcggacgcgtgggtcgacccgggaattccggaccggtacctgcagccattggagctctgctgttaattgaagacaagatcaagacaagaggagtcttaaggcctctcgaagcagaggtgtatttgccagctttggatatattgcaagcatatggtataaagctgatggagaaggcagaatgatcaaagaactctgtatattgtttctctctataacttggagttggagacaaagctgaagaagacagagacattagaccagcaaaaaaaaaaaaaaaaa

SEQ ID NO: 83 - DNA, 1113 bp, Arabidopsis thaliana
cttcttcagggttcaggtgtgaaagctgacgccaccgtggcagctgacggtagcggtacatttaaaactgtggctgctgcggttgccgcggcccctgaaaatagtaataagaggtatgtgatacatataaaagccggagtttacagagagaatgtggaggttgctaagaagaaaaagaatataatgtttatgggagatggtcggacgagaactattatcaccggaagtcgaaacgttgtagacggtagcaccactttccactccgccaccgttgctgctgtcggcgagagattcttagctcgtgacatcactttccaaaacacggcgggtccgtcgaagcaccaagcggtggctctccgtgtgggttctgatttctccgccttctacaattgcgacatgttagcttatcaagacactctatacgtccactctaaccgtcaattcttcgtcaaatgtctcatcgccggaaccgttgacttcatcttcggaaacgccgccgtcgtgctccaagactgtgacatccacgctcgccgccctaattccggtcagaaaaacatggtcacagctcagggaagaacggatcctaaccagaacacagggatcgttatccagaaatgtaggatcggtgccacgtcggatttacagtcggtgaaaggtagttttccgacgtacttgggtcggccatggaaggaatattcacaaacggtgataatgcagtcggctatctccgacgtgatccgacccgaagggtggtccgagtggaccgggacttttgcgttgaacactctgacttacagagagtattcgaacacaggagcaggggctggaactgcaaatagagtgaagtggaggggctttaaggtaattacggctgctgctgaagctcaaaaatatacggctggtcagtttattggtggtggaggctggttatcgtcgaccggtttccccttctcgctcggtctttgagagattgttgtgtaatgtgttcctacgtattgttggctacaaaaattattgattaatattgtatgaagcaaatcgtgttgtcctctttgttttgtttgggttgtgtactttctctagatcatcgtagtattagaaacgagatgaaaa

SEQ ID NO: 84 - DNA, 728 bp, Arabidopsis thaliana
caggcaaacaagaccaagaggaagaagaagaagaaaaagagaaaaggccctgtgatggacaaacccatgagtgtagactggtttgttagggaaacttgtagacgcctcaaggagaagaagtcttacatgatatacacagctgttgggtgtctcggaattgctgccttaagtgatcttgtcaatgaggtggtagcaattgagacctgtggaggtcaggtgactgctgatggcactaggaaacggacaagtggtggtgtattgtggaacatcatcaaagcgagacagcctgaagcttatagagagataatgaaaaagaccaaggagtttgagaaacaatttaggcaaccaaacacgagaccaaaatcagggcccaaaagagatcagggtagctcctccgaaggagttgcctctggaaatgtatctgctgatgaagctctggtgagcgagatgtgtgttatgccggtagctgaccagactgaatccaaaccggaaaaggaaaggaaatctgttcatgagaggatcagggtacctgtttcatatgatgaccttttcagagatgcacctttagatgattctctagcacatcattcttctgcttaagctcattactggatgacttctcttgtggaaagcaattgttttgtcgagaaatggaaagcattgattttgtcgagaaatgcattgacaaaactatatataccaactaccaagatttcttaaatacacaa

SEQ ID NO: 85 - DNA, 682 bp, Arabidopsis thaliana
gagaaggcacttcctacatatacaccagactctccgtttgatgccaccacatacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttcttgacaactcaaccggtaacaaacccgatgtgatcttgatcggaactggatcagagctagagattgctgctcaa

SEQ ID NO: 86 - DNA, 871 bp, Arabidopsis thaliana
caagaacattctcagcttctagaaggttttctcaccaacccccaaattatgagaaaattacgaaattggctaaccaactacaaaagaatgattcaattcaccaaacgaattaaatgaagcattaaattgagagtaaatgagttttcgttagagtgaaactcacgtaagtgttgagctgacgaatgaagcttgagaaattattatgcttgaagtattgaggaagaagatctttagcaaactctgctgttttccacacgacaaaagctgttccttcttcgttccatgaaacgacgtcgtctgtgctatgatcatcaactagctgatacgttttgcttaaaaacggcgccggaactgatctttgcgccgccgtcacagccgtcatctccggcgaactttttttattttaccacagaaaaataaaactaaaaataatctaatacacaaagagaagaagaaagattggaaatagaaagtcgaaggaaaaagaatcagcaactaaaaagcaagagagcggtgagaaattcccaatcccagcaataaaagccagagaggaaaacacgagaacggagaagatcggagtttcgtttggtttcttccatttaaggaaaaatctgatgatggaggaagaagatgaagacgacgaccatacttcgccggagctaatccgtgtgattaaaaagtaaataaatataaagtcttttttatttttgtgtgtatgtgcaaaacaagtaaaacaaatatataaacgagttaagtgttatgtcgaagggtctctatataacgtagtaggaagatttatagatcacaaatgttggtcctacctttgtaagaaaattaaattataaaaacggatgctgtttctagaaaaaaa

SEQ ID NO: 87 - DNA, 644 bp, Arabidopsis thaliana
gctgcagatatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggcgaaattgtaaagatatc

SEQ ID NO: 88 - DNA, 784 bp, Arabidopsis thaliana
agtccttcggtttttgctggctggtgaagcgtgttgtcgaagagagaaatctcaagctgttgctggtcctggtcatagtgtagcagtcacatcgaaaggagaagtttatactttcggatataataactctggacagctaggacatggtcataccgaggacgaagctcgaattcaacctgttagatcattgcagggagttcgaatcatccaagcagctgctggtgctgctcggacaatgctaataagcgatgacggaaaagtttatgcgtgtggaaaagaatccttcggggaagctgaatacggagggcaagggactaaaccagttacaactcctcagcttgtaacatctttaaaaaacatatttgtagtgcaagcagctattgggaattactttaccgctgttctctcccgagaaggaaaggtttatacattctcgtggggcaatgacggtagactaggacaccaaactgaggctgcggatgtcgagcctcgtcctttgttaggcccactcgagaatgtacccgttgtgcagattgctgctggttattgctaccttcttgccttagcctgtcaaccaaatggcatgtctgtttactcagttggttgcggtttgggaggcaaacttggtcatgggtcaagaacagatgagaagtatcctcgggtcatcgagcagtttcagatattgaatcttcaacctagggtagttgcagcgggtgcttggcatgccgcggtggtaggtcaggatggaagagtgtgcacttggggttggggaagataatgatgt

SEQ ID NO: 89 - DNA, 962 bp, Arabidopsis thaliana
gaagaagttccgtataacatctccattattcagatcagtagagttttaccgtcggagactgcggcggctccgactcctgctccggcggagatgaatcttaccggaataatgtcggctcatggatgcaaagtgtttgctgagactcttctcactaaccctggagcttcaaaaacctatcaggagagtttagaaggaggcatgacagtgttctgtccaggagatgatgcaatgaaaggtttcttgcccaaatacaagaacttgacagctccaaagaaagaagcatttctcgatttcctcgctgtcccgacatattactcaatggcgatgccaaatccaacaatggtccgatgaacacacttgcgacagatggagctaacaagtttgagcttactgtacagaacgatggagagaaggttaccctcaagacaaggatcaacactgtcaagatcgttgatactcttattgatgagcagcctttagctatatatgcgactgataaggttttgttgcctaaagagttgtttaaggcttcggctgttgaagctccggctcctgctccggcaccagaggatggtgatgttgcggattctccaaaagcggctaaagggaaagcgaaaggaaagaagaagaaggctgcaccgtcgccagataatgatccttttggtgactcggattcgcctgccgaagggcctgacggagaggccgatgatgcgacggcagatgatgctggtgcggttaggatcatcggaggagctaaggctggtttggtggtgagcttgctctgcttgtttgcttcttcttggcttctatagtttcacttcttgtttcttcgattcttccatgtttttttttttttgtgaatcttttatttatggtttttgggggagagtaaatgaggattatttatttccctctattgttgagttttttttatttatttaaaagttggttgtcgaattaaa

SEQ ID NO: 90 - DNA, 835 bp, Arabidopsis thaliana
ggacaaggaaggaatccctccggatcagcagagacttatctttgccggtaagcagcttgaagacggaagaactcttgctgactacaacattcaaaaggagtcgacccttcatttggtgcttcgtctcagaggtggtatgcaaatctttgtcaagaccctcactggtaaaacaatcacccttgaggttgagagttcagacaccattgacaatgtcaaagctaagatccaagataaagagggaattcctccggatcagcagaggcttatctttgccggtaagcagctcgaagatggacgcacccttgcagattacaacatccaaaaggagtcgacacttcatcttgtgcttcgtctccgtggtggtatgcagatctttgtgaagacccttaccggaaagaccattactctggaggttgaaagctcagacaccatcgataatgtcaaggctaagattcaggacaaggaagggatcccaccagaccaacagagactcatcttcgctggaaaacagcttgaggatggtcgcacacttgcagattacaacatccagaaggagtcgactcttcacttggttcttcgtcttcgtggtggaagcttctaagctttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaaaaaaaaaaaaaaaaaa

SEQ ID NO: 91 - DNA, 581 bp, Arabidopsis thaliana
atacaaacactagaagtcttataaattcaaagtatgtctgagttttacaacattagagagaaagagaacaacacagaaacatttatagaaacatgattacacatgcgctaacaactttaagatttactgagccaaagcacttgtgttgtacacaagaagagcacctccggcaagaattccggcgagagttaccgcccaaattgccaatccggtgactcctcccttgtacacgtcaccactcgctgaccactcgttctcgttgtaaataggactgtatccatcgacgttagctccatacttgtcgacgtacttgtaaacaccgtatcccttgccctttctgccggaggcgtcgacgccgtccctcaagtccatgctgccgttaattccgaagggcttgtcggtcttgatcttcttgacgccactggcgacaattttgaaggagggacgagctcttgtgagcgacggtaatcctctagccgccgtcttctccaccgtgaaaccagctggtttcaatgtcaccgaagatagcatcactgaagcagccattatttttctcacaagatgatcaaactattcttctc

SEQ ID NO: 92 - DNA, 884 bp, Arabidopsis thaliana
tttaatgcttttctaatcaataaatatcaaattatccaccagataaaaataataatttaaaaagcgtattctcaaatcgtaacaaaaagggatatttttggtgtttgtcacccaaaagtataacctatccaatgagggtatgaagaaaattgagtgaatcaaaatataaaagataaaaaaaagggaagacgaagcaaaactcttttgtatgtttcttctcattagcaaaggctggggtaaaacttagaagttgacttgaaagccactgcgtctgcgatgacctgcaccgccttttgatctgtttgagtttctttcatattggtatcgcatccccaaacccttaccgcaagcctacgacatttgggtgatgattctctgaaataggttttgtaccaactgatcacatctttcttctgtatacttcttagttcttctgcttctttgtgggagaaatcaaacatgtaccttttgtcaacaatctgactccataagtcatttgtctcggacaagagagagggatccttttccagcaatctagcaatcataccacttcggtaatcttcataggattcatcatccagttgttccagaagcccttcgatatcttttatgaaattgtcaactctccccagcaaatgaactggaccgtacttagaagattgaacacagaaacagaaaccgtgcacacgatacgttaagcgagggccacactcgacaacataaccaagctgctcctttgtcctcaactgattgaacaatggctcttctatgatttcatgaaagagatccagcacagctttcgttctcgttgattgagcttcttcaggctcgatttgatagtaaagctcgactactgagtttgtttcagatttgttcttcacatt

SEQ ID NO: 93 - DNA, 730 bp, Arabidopsis thaliana
gtaggggcaaaacatattataccataaggaccacaaaacatcacaacaatgatattttcaacagagtactagtagagtatgtttataaggagggatagggaatttttttcaaacatagaacagattctctgagagagaatgttttcataagagagtattatatagctaactctgatttcagcaggtcaagagaggagatgaaccactgcatttgacatcagaagcatcagaaaggcgttgtcttggagagagtgttgtaatcgctgcaacatctacgtcgagattcactatgagcttcctcttctgcgactctgttacactgttccttctctcttctgatccttcagcaatgggactcaaagtctgtgtctctgctgctccaacgtcttctccatctgctgcgtataggattctttttatggaaccaacaagaggtaagtgctctgtgtctgggttttgacagagaatctctacatctctgagtttagagaaatagaaatctctctctttctctaagctgtcaatgtaaagtttcagttctgtgatcttttcatcataagcaggcactggtttagattgtttagctgatggttttgaagagtggtggtgattcccagttgaagaatggtgagtaccggtgttgttggattgtggctcatgcttacgggttccatttgaagatgaaggtcgaggtggagctgaagaagacgaactcttgcctgattgttgt

SEQ ID NO: 94 - DNA, 1706 bp, Arabidopsis thaliana
aagaaaagtaattctctgtttgtgtagttttctttaccggtgaattttctcttcgttttgtgcttcaaacgtcacccaaatcaccaagatcgatcaaaatcgaaacttaacgtttcagaagatggtgcagtaccagagattaatcatccaccatggaagaaaagaagataagtttagagtttcttcagcagaggaaagtggtggaggtggttgttgctactccaagagagctaaacaaaagtttcgttgtcttctctttctctctatcctctcttgctgtttcgtcttgtctccttattacctcttcggcttctctactctctccctcctagattcgtttcgcagagaaatcgaaggtcttagctcttatgagccagttattacccctctgtgctcagaaatctccaatggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaagaatcgtgtgatattttttttgtaaagttttgaatgacaattaaatttatttattttattaagttttttttggtaaaaaaaa

SEQ ID NO: 95 - DNA, 737 bp, Arabidopsis thaliana
agaagaagttaaagcaaaacacatacaaacgcagtcaccttctctgtcgcctccttcttcaatctcatcgcaatcatgatcatatccgagactaatcgccgtgagatctccaagtacctcttcaaagagggtgttttgtttgccaaaaaggatttcaatttaccacaacatcctttgattgagagtgttccaaatctgcaagttatcaagttgatgcagagtttcaaatctaaggaatatgtgagagagacctttgcttggatgcattactactggttcctcacaaatgaaggtattgactttcttaggacttaccttaatctcccatctgagattgttcctgctactctgaagaagcaacagaagcctcttggtcgaccttttggaggtggtggtgaccgtccccgtggccctcctcgtggtgatggagagaggaggtttggtgacagagatggataccgtggaggtcctaaatcaggtggagagtatggtgacaaggctggagcacctgctgattaccagcctggcttcaggggtggagctagtggagcaaggcaagggtttggtcgtggagctggtggttttggtggtggtgctggtccagctgctggatctgatctaccttgaaaaggactttcttgtttctttttggtcttatttaaggttacatagcaccttattgagaacgaatgtgtcttttggaactttgtttctttctcttaaaccatttcacaaaa

SEQ ID NO: 96 - DNA, 907 bp, Arabidopsis thaliana
agaaaaagaacaaaaacctaatttcaagaaattcaataaatatcatcctccggataagttgttattgtacgtttaccaaattcaagaacaagaaaaaacttttcctttgaaacaaagaaacatggatttcttcaccgatcaagtaaagaagaaattctccgacaagaaaccggagagctctgatccggagccaaaccacaacaaaaacaaacccggtcacacggagccaacaacacataaacccggtcacggcgagccaacaacacataaaccggtctccaacaccgatccaacaacacacagaccggctacgaacgctgagctcatggctagtgccaagatcgtagccgaagctgctcaagccgctgctcgtcacgagtcagacaagcttgacaaagccaaagtcgccggagccaccgctgatatcttagacgccgcttctagatacggtaagctcgatgaaaagagcggtgttggtcagtaccttgaaaaggctgaacaatatcttcacaagtacgaaacttcccactctcactcctccaccggtggaactggaagccacggtaatgttggaggacacggtggtggagctggagcaccggcggctaagaaagaagatgagaagtccggaggtggtcatgggtttggagattatgctaagatggctcaaggttttatgaagtgagtaatgttttagtttctaaaaataattatgttagtaattatcttctataattactgttttagtaagctgttgttttttctgaattattattaactgttggatttgtcatttgtgtatgatggaggaaattatgatgttaaagatcatgtatcatgttgttgaccactcgagattgcgttaatcaaatatttgtataattagaaccgaactttaagttaaaaa

SEQ ID NO: 97 - DNA, 436 bp, Arabidopsis thaliana
atacaaggaaagtgttttgccatctgatgtatcagctagagttagtatcgaagctggatcgacttttggatggggaaagatcgtcggaggaaaagggaaatcgattggaattgatacgtttggagcaagtgcaccagcaggaaagctttataaagagtttggtatcaccattgaagctatggttgaagcagccaagtcacttatttaaaaaagtatcttacaggtactaccgaggtttgcatttgaagtaagagacattccataagcattatcttctttgtccaaataaaaatatactccttccaatctttttataaatgatgtttaaagctttcattttggtttttaaataaatgatgttttaaattttcaatgcaaaattatttttattggttgattaataaatgatgttttaggcttttatttatattttaaa

SEQ ID NO: 98 - DNA, 413 bp, Arabidopsis thaliana
cttgtcaaagagaagtgtgtttgcgtcatcttcgattagtgtggggaaaaacttggaggatatgtcagcgtatattcatttcttggcgtctggatttgaagcttccagaacagcttttggtgctatacctggaagcttgcagcccgatgaagagttatgtagagatcttggtttgtctctcaacactccttccccaaatactcgcaagcaagattgacctgttttttaatttatctttgtctgcatatcattgggatatttttgtgtataaatcaatgtatactatctgaatcattctatagcagctttggtgtaatattgatgatgaaagttagatttttcatctaaaaaaaaaaaaaaaaaaaaaaaaaaaaaaaaaaaaaaaaaaaaaaaaaaaaaaaaaaaaaaaaaaa

SEQ ID NO: 99 - DNA, 1365 bp, Arabidopsis thaliana
tttttttttttaagaagaagttcgacttgtcattagaaagaaagagataacaggaacggaaacatagtagaacacttattcatcagggattatacaaggccccaaaacacaaaccaccaaagttttacatgaaacgaaacattgaacttcttaagcataacagagacgagatttagaaaccaccacgaagacgcaggaccaagtgaagagtagactccttctggatgttgtagtcggccaaagtacgtccatcctcaagctgctttccagcgaagatgagacgctgctggtccggaggaataccttccttgtcctggatcttggccttgacgttgtcaatggtgtcggagctttccacttcaagggtgatggtctttccggtcaaagtcttgacgaagatctgcatacctccacgcagacgcaacaccaagtgaagggtcgactccttctggatgttgtaatccgccaaagtacgaccatcctccaattgttttccggcaaagatcaacctctgctggtccggagggattccttccttatcctggatcttggccttcacgttgtcaatggtgtcagagctctctacctccaaagtgatagtctttccggtgagagtcttcacgaagatctgcatacctccacgcagacgcaagaccaagtgaagtgtggactccttctgaatgttgtagtcggccaaagttcttccatcttcaagttgctttccggcgaagatcaatctctgctggtccggaggaataccctctttgtcctggatcttggctttcacgttatcaatggtgtcagaactctccacctccaaagtgatagttttcccagtcaacgtcttaacgaaaatctgcataccaccacggagcctgagaacaagatgaagggtggactccttctggatattgtagtcagcaagagttctgccatcctccaactgctttccggcgaagatcagcctctgctggtccggaggaataccctctttgtcttggatcttggccttgacgttgtcgatggtgtcagaactctccacctcaagagtaatcgtctttcccgttagggttttaacgaaaatctgcataccaccacggagcctgaggaccaagtggagggtggattccttctggatattgtaatcagccaacgtacggccatcctctagctgcttgccggcgaaaataagcctctgctgatccggaggaatgccctccttatcctggatcttggccttaacgttgtcgatggtgtcggagctttccacctcgagggtgattgtctttccggtgagagtcttaacaaagatctgcatcttgatcacggtagagagaattgagagaaagtttttaagattttgag

SEQ ID NO: 100 - DNA, 878 bp, Arabidopsis thaliana
cgtttgtttgcaactcttgatccaactacgagaagggttcagatgcaaaacgggaaggaatttcttctcacagatactgttggttttatccaaaagttaccaaccactctggttgctgctttcagagcaacacttgaagaaatagcagagtcaagccttttggtgcatgttgttgacatcagccacccactggcagagcaacaaatagaagctgtggagaaggttatgtctgaactcgacgtttcatcaattccaaaattggtcgtgtggaataaggttgatagagtggatgatcctcaaaacgtcaagctggaagcagaggaaactggggatacaatttgtatatctgctctgactggagaaggactagacgacttctgcaatgctgttcatgagaagctcaaggattcaatggtttgggttgaagcccttttgccatttgataaaggggaccttctaagcaccatacacaaggttggaatggtgaaagaaactgaatatacagagaatgggacacttatcagggcacacgttccgctacgttttgcacagctgcttaaacctatgagacacttggtcaaagatacttcaataagccaaagaggatgaaccagaatcatagcaagaacctgaaggcctgcctcttggtgagaatcggaggctacgtgtgctttgccaaagcatccgaaagcaaaaggaattcaaacaaccttctgatcatacacaccacaaagaatgacagtcagacagtaaagaatattcgtagataaaaaggaatgcagctagacacaagcaagataagcttgaacctacttcacatcgtgaactgacactggaaatgttatttcaacagtgataagtgataaccctttttgtaa

SEQ ID NO: 101 - DNA, 280 bp, Nicotiana benthamiana
caaaggaagagctggacaaagatctcattcagaaggcaagaatatttcactatgggtcaatctctttaatcgcggaaccgtgtaggtcagctcatcttgcagccatggagattgccaaaaaagctggctgcattctctcttatgacccaaatctaaggttgcccttatggccatccgcagatgctgctcgtaaaggcatcttgagcatttgggaccaagccgacgttattaaggtaagcgaagacgaaatcacattcttgacagacggtgaagacgccta

SEQ ID NO: 102 - DNA, 476 bp, Arabidopsis thaliana
aacataacattaaactgctttcacatagaaagcaaaagtcttaaacaacattacattaactcctttcacataaacagaaaagtcttaaacaacattacataaactcctttcacacagacacaaaaggctctttcttgctcaacgcatcaacactcttagttcaagatttcacctgtaatgggtgaaacatgttggctcgtagacttctgcccattttttgaaccgaccactaccataggctttggtggtatcaaaccggccctgaaaagcatgctttccactgtgtctgttggttgagctccaacagataaccagtacttgattctgtcgaatttgaggctcactctatccgcatcttctttgccttggagtggatcataaaagcctaacacctcgatttgtttaccgtccctgcgcgatttttcatcggcgacaactacacgatagaagggtcggtgtttacaaccaagacgcgc

SEQ ID NO: 103 - DNA, 713 bp, Arabidopsis thaliana
gattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgcg

SEQ ID NO: 104 - DNA, 1094 bp, Arabidopsis thaliana
aaatcagtgagaaggtgcaagtcgctcacaagagaagaaatcgacactttttggaaaacgaagaagaagaatgaagaagaagaacatgttcaagccttttccaagttggtaactcaggaaggtgcacaaagccaagcgaaagagaagaagagtgtagatgatctttttgagaaccaaagcaagagtagtggatggtggagaaaaacctactgggcgttcttgaatgagccgagggaggaagagggtcgaccgaacaactacgtgtcgcaattcaaagttgctcacatcgccaaaattgcgggctcgtaatgacgctataatcaccggctaatcacatatatatctcgtgtgaaatgcgattagtcgtctgccgttgtggtttaatcaccggctaatcacatatatagtatgttggccgtgttagtatgtgaatgtgtgagtagagcatgtaacaaagggtgtacgattttaatgtaagaatgtgttttactttatatgtgtcatgtatgtatttttttggttgtgtgagggtgtaatgcggccgcaaaaatatcattcatagggccactctcattttttttaggatttagaacaaaatccgaaaaggagtgacataacattacaacattaggaataaagtagataaaacattgatcaaaggaaatttagttatagttgaaaatttttattataaaaagggaacgaagggagattttttcaagggcattttggtccaccctcttgagttttccagttgttgtagcaggagcaaacttgtttgttcccatagtaacccggaggcacacagagacacttcctgcagcatttgttgcagaacgtaatgcaagccttgtggtactgtgtctttttacacctcctatcacattccgatgggcattgggtacgtttcaggcttcctggtccataacgtttctggctccacttcacattagatccacttgaggccataaccatggtttgaagcatgaagaggacaatgagggtcaagaggaagatagctccatatgacttagccattttcagtttgggatattgttatccaaagaaccaaacactcctctaaatctcccgcg

SEQ ID NO: 105 - DNA, 663 bp, Arabidopsis thaliana
gcaacatacgtcttttctaaatcattacatttgaagaagagaaacaaaaacagagcggaatgccgaatttgtttctcttctcgattcaaccatccgaaaacaagaatacaaaaagagaagataatcgcggaaacagattacgtaatagaagcttgagttgttttgtttctatttcttttcgagaaagctccgaacttcagcatctgagggaagagctggaatggctccttttttggtcgttgtgattgctccacaagcatttgcgaatctcagcactttcctcaatctctcttcgtcctcgagaacggatcgatcatcgacaatctggtttagaagagcaccgacaaaggaatctccagctccggttgtgtccacagcgttcacatggaaagggtcaacggctcctttgaaagtcttggtgtaataccgacagcccttttcaccaagagtgactaacaacagcttcaagttgggatgccacaaggtcaacgcggtctcatcatcaatcttgttgcttccagttagaaactcaagctcaacatcgctcaccttgatgatctcagctttgtcccaaatgctcatgatctgtgttttggcttcttcttttgatggccacagaggctccctgaggtttgggtcataggaaagaagagctcctgcgcg

SEQ ID NO: 106 - DNA, 588 bp, Arabidopsis thaliana
aattagtcttaattgatacaaaaacatcattaaaaaagcaagtgcaaaaattctgagtagagaatgataataaaatggaaaaaactcaataaccacccttgagatcgttgacaacatcgtaaggaatgggagtgacagtctccaatgtcataccttcgaccatgaaacccggtttaggacctttaggctgtctcttggtgctgatagtctctcctctggctttagcatcagccttaagcacatcgttctgcttctttctgagtttaaactcctcagcacaccttgactgttgcacatgctccacacgcacatgtatcctcttccttatgattctgttcccaatctgtttgttgacttcaacaccaacggcacgcttagtgacattccagatgcgaccagtacgaccatggtagaacttatgaggcatacccttgtggatagctccattaaccttgacatcgacgtaatcgccgaccttgaaggttctgaggtaagtggagagtggaatataacccttcttcctgaatggtctcgcgaacagatctcttattctcgccctcactccgtgtcccgccggcattttcagcg

SEQ ID NO: 107 - DNA, 550 bp, Arabidopsis thaliana
aagcgaagagtctgaaagcgactaaatgtacattataaagaaacagattttgattttgaaagatctagtaacaaaaacaaatttccgttatccccatgttcttatgcagccatgggcacagcttctgatggtgctgcagcagctgcgtctgggacgtaccaaccatggtgaatttcaacggcttttttcctcctagccaatcgagacttcctacgggcaccagtgttcttgtgtagtgctttaaccttcactgctttgtcaattgcagaataagcctctcctatcagtttctccaccgtcacaatctcatcagcttgcgcatcagttttcttcttgagcccctcaagtgcttccaagaccttcttcatccgggtacgggcttcagatttcttagatttgttgtaaacacgcctcttctcagcttggcgagctctctttgcagctgaatcagctttcttggtaggagcagcagcctcacacacaatcaattgcctcattggcttctgtacccacaaattcccggttgagaaggcgacgcattgagaaacgc

SEQ ID NO: 108 - DNA, 1111 bp, Arabidopsis thaliana
gtcttcttatgattaccctctcttccctaattacatggctaatactcagtcttctaaagccaaggctcggtctcaaagtgcgccgaagcagagacctcctgagatctatgagaagcagatgagtgggaggagaagatcttcgatggaagcaccgaggaataacggtgtcccgagagctgtaaggatgcagagatcttcatctcaactagggtcaaacacagccaaggaaagtcaacaacatcatcatcatcagtactatccgtggatggcgataaagctcgatagatctaatatttcgcttatggagagcgaatgcggatctacaagtaccgttatgactaataccaactacggtagacatgttgatgttcagggaaacaacaacatgtactgaacactgtgctttagaatttgagagattgctggaaaaataggcaagcctaaaaaacgaagaggacaggtttataggagttttttttatgatgatggagatttaacaatctctatatgtaaagcaaaaaatgtagtagactgtagaagtgactcatctcgtcttaaattttgatttttcctttttaattatcattcgaattaacgttaagcggccgcgctatcacacaccttggaagaaaacgaagtattccctgcgcagtttggacgggaggttctagcagggttgctaaagatcccagatagggccgattggagaaactgtaaaattagccaagaagaggaggcaaagctggctgaagatttcaagaaacaatttcaagaatttgacccttgccaataaccttactgaacaaaagatacgattagatgctatcttgtgggcatcaatcatgctaaactcagtctccagtgcactcaggtcagaagctgaatcatgcgaagcatcgtcgtttagaaataggtttgtcaacagtgttctttgtttggtcagttaaaagctaacagtcttccatcagtttccttactattttactggttagttgttacctatcttgttcttctattaaacattttttttgatatattattgtttgttgagatgtaagagagtgatcatcacagaaacacacaacagtcatggtagaatttgcttcacgcg

SEQ ID NO: 109 - DNA, 612 bp, Arabidopsis thaliana
tgcatgttccctaagttaacagaggagacaaaagatgatgataagttacattttagaacacaaccatatttcctcttcagactcgccacacaaacctctataagcgagagaaagaagctgaaaaaaaccactctctttctttatttagtaagagttttgccagagctgctgctgagattgattcgacggttgaccagcctgagacccagcaccatccctagggttttgctgctggcgctcgagtgacatttcggtctgagactgataataatttgggtatccatgagatccataatgctgttgttgctgagcttggcgataccctcccgctgcttgctgagcctgctgttgttgttgctggtgttgtagttgcagttgttgttgtgcttggaggttgtaatacgtgttagtcgggacacctgacatggttctggaaccatgaccctgatgccacatcgccgagttttcgttctgttgttgatgttgctgttgttgctgctgctgctgaagtgccaacagatgattctctttgtattgagaactaagaacatcgtcataaccaagcgttgtaccggtagtagcagactgttggttaagagggaagtttccgcg

SEQ ID NO: 110 - DNA, 703 bp, Arabidopsis thaliana
actgagttcgataggatactattgttcgaacaaattcgtcaagacgccgaaaatacctacaagtcaaatcctttagatgccgataatctgactagatggggaggagttttactcgagttatctcagtttcatagcatctcagatgcaaagcaaatgattcaagaggccatcacaaagtttgaagaggcattgttgattgacccaaagaaagatgaagcggtttggtgtattgggaatgcatacacttcatttgcgtttctgactcctgacgagactgaagctaaacataactttgacttagctactcagttctttcaacaagctgtggatgagcaaccagataatacacactacctgaaatcactcgaaatgacggccaaggctccacagctgcacgcagaagcttacaaacaaggcttaggctcacaaccaatgggtcgcgttgaagctccagcaccgccgagctcaaaggcagtgaagaataagaaaagtagtgatgccaagtatgatgctatgggttgggtgattctagccattggtgttgttgcttggatcagtttcgcgaaagctaatgtgcctgtctctcctcctcgttaagtagactcgttaggagactttgatgaagtttttcaatttttgaggttttgacagttggagcttgttgtgtaagatttttagttgtactacgagtactttattagcg

SEQ ID NO: 111 - DNA, 514 bp, Arabidopsis thaliana
gggacgtcaaggagagagagttagattgtatgttcgtggaacagtcctcggttacaagaggtccaagtcgaaccaataccctaacacttctctcgtccagattgaaggtgtgaacactcaagaggaggttaattggtacaagggtaagcgtttggcttacatctacaaggcaaagacaaagaagaacggttctcactaccgttgcatttggggcaaagtcactaggcctcatggtaacagtggtgttgtccgttctaagttcacttcaaacctaccacccaagtcaatgggagctagagtcagagtcttcatgtaccctagcaacatatgaggaggctagatttcaacaagtatcggaaggaatcgccattatcatttctcaggagctgtagttttatctattcacttttattctagactctctgttggttttgattttatcttgagacgaagtaaaacattttttttcttgagatcatatactatcgagtattaatggaacttgagaaaagcg

SEQ ID NO: 112 - DNA, 800 bp, Arabidopsis thaliana
ttcttacagcattctatcctgaagatcactgaatatactagaggcaaatgttcccagcttattctttgtttcctcagctaagttagcaatagatgacatatcttgctgcgcctggaaagaaattcggttgatgagatcgcttgcagtgatatcgatgttggaatcatctggtccgtggccaaaaagatcagaacttgaaatagctgctgaacccgagaacttctgaagggtagcttttgagtcaagatcggcatctctgttctgatttccgaaaaattgggcagaggaaatcgatttggcgtttgaaaacttctttcttgcttcatctgtttcttcaacctgagctttggatgagcttgagcttgacttcttggggaaagcactgtccattccaaattcattaaagaaatttgatgactttggtggagcaacatggctaagcacccgtgtgccactttgcccaccagattgctcatcatcaaagtactcaaatcgagaggcaaatgatgatccagctgctgatgtgtcattggttggagaagcagcaggaatcacaggtacaggttcttcaggcttctgctcatagaggttatcctttgacttagtagtaagcttacgagcaccaagaccaccagtcttcccagactttcgcgaaacaagaggtttcttaaacgtactagcaacaactttctgagaagcttttggtgaagagacaacagctgcttcttgcttcaaagaactctctttcggagattcagaagtaaacccattttcagatgattccactggctgagaagcgc

SEQ ID NO: 113 - DNA, 745 bp, Arabidopsis thaliana
gcaaccttcgattttcgtttattcgcatccatcggagagagaaaacaatcaataagcgaccatgttggtgtaccaagatcttctcaccggtgatgagcttctgtctgactctttcccttacaaggagattgagaatggaatcctctgggaagtagaaggaaagtgggttactgtgggagctgtagatgttaacattggtgccaatccatctgctgaagaaggtggtgaggatgaaggtgttgatgactctactcaaaaggttgttgacattgtcgacaccttcagacttcaggagcaaccaacttatgacaagaagggattcatcgcttacattaagaaatacattaagcttttgacacccaagctcagcgaagaagatcaagctgtcttcaagaagggtattgagggagctaccaagtttttgctccccaggctcagtgacttccaattctttgttggggagggtatgcatgatgacagcactttggtctttgcttactacaaggagggttcaactaacccaacatttttgtacttcgctcatggtttgaaggaggtcaagtgctgagagagaagctctcgttgggttactgtggtcggtcgcagcgactctctaagtttatgtttctttatattgtcctgtgtttcgtcgtcgtcccctattaaaattacctgccagtttacttttctctcttcttgttttctgtgttggaagattctcaagttatttattccgcaaaaagcg

SEQ ID NO: 114 - DNA, 596 bp, Arabidopsis thaliana
tacaaagtttacactgttgatgcatacggatctttccttatcgataacttctctacatttatcaagcaagtgtatgcggttggagcaaggaagatcggtgtgacatctctgcctccaacaggatgtcttcccgctgcaagaacccttttcggtttccatgaaaaaggctgtgtttcaagactcaacacagatgctcaaaactttaacaagaagcttaacgctgctgcttcaaagcttcagaagcaatattccgatcttaagattgttgtcttcgacatctactctccactttatgatcttgttcagaacccttccaaatccggattcacggaagcaaccaaaggatgttgtggaacaggaacagtcgagacaacttcactcttgtgcaacccgaaatcgtttgggacatgctccaatgctactcagtatgtgttctgggacagtgtgcatccttctgaagctgccaatgagattcttgccactgccctaattggacagggcttttctctcctcggttgatctcacgtatttttcttatattctcttttcaaatcgctgtttctatcacacattgagtcatacatttgtttttcgcg

SEQ ID NO: 115 - DNA, 572 bp, Arabidopsis thaliana
gacaaattcttccattagaagaagaagatggctcttctctgcttcaattctctcccttctctctcttctctttcttcttcttcttcctcgcgccttcttcaatctccgtctttcgcttctccagttttgagccttaaacccaacgctgtcgagtccaagaacagagtctctctcagtgcttacagcttgaactctagccatggaagaattgtggtgaaggcggctgcttctggcgtggacggggctgagcctgagagcaaggaggaaccaaagactgttgttgctgctgttccagtggataaactaccgttggaatcgaaagaagctaaagagaaactgctcttggaattgaggctgaagatgaagctggccaaaaagattaggctacgcaggaaacgtctggttcgtaagcgtaagatgaggaagaagggtcgatggccaccttccaagatgaagaaaaacaagaatgtctaagtgactcaactgtttgctgcttttcgtattcgttttttgtaatgttctttttggtgttcaaagaccattaatgtacttcaaatgcaaccattgttttt

SEQ ID NO: 116 - DNA, 622 bp, Arabidopsis thaliana
gcgtcgacctagtgagctacttcagattccggccatcacgcagctccagttgtatgctttgagagttaatacaaagatgacaacaatcgaaaccggtcagaaaactcaaaagtcttctccttccggttctggtactacccctactggtactcttaagcagtcatcagcatcgtttaaaaggtggggaaggagacacccgtttgtaagatatggacttccgatgatatctctcactgtatttggagccctcggactcggccaactccttcaaggcagttcagtaaggatattgcaaaggtaaaagatgaccaagaatgggagattatagaaacaagaaaggcactttcgagaacaggacctgtcgatgcctataaacctaaaaacacatccattgaagatgagctcaaggctatgcaagagaaggtggacataaacacgtacgagtacaagaaaattccaaagctaaacgaaagcaagtcgagttaagaagagtctttgtataagattagtctttttagatgtgtttcagttttaaatgactcttcagttcacataatcgcccaagtacaaattccagtaagttctgtctgggcttcctaaaaccaagaacaacgagggactt

SEQ ID NO: 117 - DNA, 630 bp, Arabidopsis thaliana
gtcgatgtgtacgtccgtgtaaccggaggagaagtgggagccgccagttctctagctccaaagatcggtcctctcggtctcgcaccaaagaagatcggagaagacatcgcgaaagagacggccaaagaatggaaaggacttcgtgtcaccgtgaagctgacggttcagaatcgtcaagctaaggtaaccgtggttccatctgctgcagctctcgtcatcaaggcgttgaaggagccagagagagaccgtaagaaggtgaagaacattaagcataacggtaacatctctttcgatgatgtgactgagattgctaggattatgaggcctagatctattgctaaggagctgagtgggactgtgagggagattcttggaacgtgtgtctctgtgggatgcactgttgatgggaaagaccctaaggatcttcagcaggagattcaagaaggtgagattgagattcctgagaattaaggaacaatggagtttttttttcttcttatgggaatttgaaatgcttctgttgttatctttctcgttttaccatattttgtttttgtttgggaacttagctgctatgatgtttcacttagaatgactctcaagttttggattcttattattctctgtttc

SEQ ID NO: 118 - DNA, 379 bp, Arabidopsis thaliana
gtttccttggtggaagtgctgaccttgcatcatccaacatgacattgctgaaagccttggcgacttccaaaaggccacacctgaagaaagaaatcttaggtttggtgttagggagcacggaatgggagccatctgcaatggcattgcccttcacagccccggtcttatcccttactgtgcgacgttctttgtcttcaccgactacatgagaggtgccatgagaatctcagctttgtctgaagctggtgttatctatgttatgacccatgattccattggtcttggagaagatggaccaacccatcagcccattgagcacattgcaagtttccgtgctatgcccaacactcttatgttccgtcctgctgatggaaatgaa

SEQ ID NO: 119 - DNA, 815 bp, Arabidopsis thaliana
tgcagcaatctctagctcagaaccagttccaatcaagatcacatcgggtttgttgcctgaagagtcgtcagaaattgtatatcacccttttccactccttcgatggatgtacctggaagatgaggcagcttttgcctagacagagctaagatagatggtgtcttgcgcttggtgacagcgatcttgtatgcaccggctgcggaggtgctcaggaaagacggcaaaaccgttagagttgtttctttcgtgtgctgggaactatttgacgagcaatcagatgaatacaaggagagtgtgttgccatcggatgtatcagctagagttagcattgaagcagcttcgactttcggatggggaaagattgttggaggcaaaggaaagtccattggtattaattcattcggagccagcgcaccagcacccttactctacaaggagtttggtatcaccgttgaagctgttgttgatgcggccaagtcattcttctaagagatttaagatcggaccattctctctgagggggttttgtctgaaacttgatttggaaacaaggctattcacaacattgtctcatatctcgaaataaagtgcaacaagacacaaagactttcactttcttttttgtttttgttttttgtacttcaggtcaagataggttttcggtttgagaagagaaacaaattagaaagacaatgtaaaactcccatgatcattcgtgtaatgctaaatgcttgaatttcagcaaaaaaaaaaaaaaaaaaaaaaaaaaaaaaaaaaaaaaaaaaaaaaaaaaaaaaaaaaaaaaaaaaaaaaaa

SEQ ID NO: 120 - DNA, 1106 bp, Nicotiana benthamiana
ggaaaacaatcacctggttgtttgtttcggggagttgttgattgacttcgttcctactgtatctggagtttcacttgcagaagcgcctggatttgagaaagctcctggtggagctccagctaacgttgcagttggtatagcaagattaggaggttcttccgcctttattggcaaggtgggtgcagatgaatttggttatatgttatctgatatattaaaacagaaccatgtcgacaattctggcatgcgtttcgatacccatgcaaggacagcattagcatttgtcactttgagagcagatggcgagagagaattcatgtttttccgcaatccaagtgctgatatgcttcttacaaaggaagagctggacaaagatctcattcagaaggcaagaatatttcactatgggtcaatctctttaatcgcggaaccgtgtaggtcagctcatcttgcagccatggagattgccaaaaaagctggctgcattctctcttatgacccaaatctaaggttgcccttatggccatccgcagatgctgctcgtaaaggcatcttgagcatttgggaccaagccgacgttattaaggtaagcgaagacgaaatcacattcttgacagacggtgaagacgcctacgatgacaatgtggtgatgactaagcttttccacccaaaccttaagcttttgctggttaccgaagggggagaaggttgcagatactatactaagaattttcacgggagagtgaatggcattaaagtaacagcagttgataccacaggagcaggtgatgcatttgttggcggacttctcaacagtatggccacagatccagacatttatcaggatgagaagaaactaaggaatgcactcctttttgccaatggttgtggagctataactgtgacagaaaaaggagcaattcctgcattgccaacaaaagcagcagtgcttaaaatcttggatggtgccacagctaactgatccaatcaaattccccccacccacagaaaagcctcctaatctccaccccttgtaagacactacactagtacttcgtgtacaaattatcatatatactggaatttactccaaaaaaaaaaaaaaa

SEQ ID NO: 121 - DNA, 617 bp, Nicotiana benthamiana
gcttcttcttcttctctcactctctctcaagctatcctctgtcgttcagtccctcgccatggctctgcctcttcttctcaactttccccttcttctctcactttttccggccttaaatctaaccccaatatcaccacctcccgccgccgtactcctccctccgccgccgccgtacggtcatcgacgattcgtgcatcggctgcaaccgaaactatacagaaaactgagactgcccttgttgacaaatctgtaaacactattcgatttttggctattgatgctgttgaaaaggcaaattcgggtcaccccggtttgcccatgggttgtgctccgatgggtcatatactgtacgatgaggttatgaggtataacccgaaaaatccgtattggtttaatcgggatcggtttgttctatcagctggacatggttgtatgcttcagtatgctttgcttcatctagctggctatgatgctgtcaaggaagaggacttgaagagcttccgtcagtggggaagcaaaacccctggacaccctgaaaactttgagacacctggtgttgaagtcaccaccgggcctctgggacaaggtattgccaacgccgttggcttggcccttgc

SEQ ID NO: 122 - DNA, 1252 bp, Nicotiana benthamiana
ttttcttctttattgtatagatatatactttacatacacatattctctctattcatagtcggtatggcagctaacggcgttagttctggtttaattgtgagcttcggcgagatgttgatcgatttcgtgccgacggtctccggcgtttcccttgccgaggctccgggtttcttgaaggctcctggcggtgcaccggcaaacgtcgccatcgcagtgactaggctcgggggaaagtcggcgttcgttgggaaactcggcgacgatgagttcggccacctgctcgccgagatactcaaaaagaacggcgttcaagccgacgggatcaacttcgacaagggagcgagaacggcattggcattcgtgaccctacgcgccgacggagagcgtgagttcatgttctacaggaatcccagtgctgatatgttgctcactcccgacgagttgaatcttgatgttattagatctgctaaggtgttccactacggttcgataagtttgatagtggagccatgcagatcagcacatttgaaggcaatggaagtggcaaaggaggcaggagcattgctctcttatgacccaaacctccgtttgccgctgtggccgtcggcagaggaggcgaggaagcaaatcaagagcatctgggacgaggcagatgtgatcaaggtgagtgatgtggagctggaattcctaaccggaagtgacaagattgatgacgaatctgccatgtccttatggcatcctaatttgaagctcctcttggtcaccctcggtgagaaaggctgcaattattacaccaagaatttccatggaggtgttgaggcattccatgtgaagactgttgacaccaccggagctggtgattcttttgttggtgcccttctaaccaagattgttgatgaccaatccattcttgaggatgaagcaagactgaaggaagtactaaggtttgcatgtgcatgtggagccatcacaacaaccaagaaaggagcaatcccagctcttcctactgaatctgaagccctcactatgctttacggaggagcataggacgaagatgatgttacccttttaattctttttaatcgtgatatatttcgaccgtttacgagtttttcctttcaatcaatcaaaatagtttcagcctttcatttcacttttggggtttcggattttaatggtttcttgtaatgatgaaagactatgcattaaggcacttaataaagtaagctttcttcctaaaaaaaaaaaaaaa

SEQ ID NO: 123 - DNA, 589 bp, Nicotiana benthamiana
atactttacatttatacatatattctctctattcatcgtcgctatggcagctaacggcgttagttctggtttaattgtgagcttcggcgagatgttgatcgatttcgtgccgacggtctccggtgtatcccttgccgaggctccgggtttcttgaaggctcccggaggtgcaccggcaaacgtcgccatcgcagtgactaggcttgggggaaagtcggcgttcgtcgggaaactcggcgacgatgagtttggccacatgctcgccgggatactaaaacaaaacggcgtccaagcggacgggatcaactttgacaagggcgcgagaacggcgttggcattcgtgaccctacgcgccgacggagagcgtgagttcatgttctacaggaatcccagtgccgatatgttgctcactcccggcgagttgaatcttgatgttattagatctgctaaggtgttccactacggttcgataagtttgatagtggagccatgcagatcagcacatttgaaggcgatggaagtggcaaaggaggcaggggcgctgctctcttatgacccaaacctccgattgccgctgtggccgtcggca

SEQ ID NO: 124 - DNA, 561 bp, Nicotiana benthamiana
ggatggccttatgagccgttccacgtgcctgaagatgtcgggagccattggagtcgtcatgttcccgagggtgctgctcttgaagttggatggaataccaagtttgctgaatatgagaagaagtaccccgaggaagctgcagaactcaaatccattaccactggtgaactaactgctggctgggagaaagctctgcctacctacacacctgaaagtccagcggatgccaccagaaacttgtcccaacaaaacctgaatgctcttgccaaggttctccctggtttccttggtggtagtgctgatctcgcctcatcaaacatgactctcatgaaaatgtttggtgacttccaaaagaacaccccagaggagcgtaatctaaggtttggtgttcgtgaacatggtatgggagctatatgtaatgggattgctctacacagccctggcttgattccctactgtgctactttctttgtgttcactgactacatgagaggagcaatgagaatttcagccttgtctgaggctggagttatttatgttatgacccacgattcaatcggt

SEQ ID NO: 125 - DNA, 610 bp, Nicotiana benthamiana
aaaacccctggacaccctgaaaactttgagacacctggtggtgaagtcaccaccgggcctctgggacaaggtattgccaacgccgttggcttggcccttgcagagaaacacttggctgctcgcttcaataagcctgacgctgagattgtagaccactacacatatgttattctcggtgatggttgccagatggagggtatttcacaagaagcttgttcacttgctggacactggggacttggaaagctgattgctttctatgatgacaaccacatctcaattgatggtgacacagaaatcgctttcactgaggatgttggtgcccgttttgaggctcttgggtggcacgtaatctgggtgaagaacggtaacactggttatgatgagattcgtgctgctattaaggaagcaaaagctgtcacagacaaacccactatgatcaaggtgactacaaccattggttttggctcgcccaacaaggcaaacagttacagtgtacatggaagtgcacttggagctaaggaagtagaggccaccaggagtaacttgggatggccttatgagccgttccacgtgcctgaagatgtcaagagccattggagtcgtcatg

SEQ ID NO: 126 - DNA, 803 bp, Nicotiana benthamiana
ttgttgctgagcatgccgctgccaataacaagatattctcgatgaacctttctgcaccattcatctgcgagttcttcagggatccacaagagaaagccttgccgtatatggattttgtattcggaaatgagaccgaagcaagaaccttctcaaaagtacatggatgggagactgataatgttgaagaaatagctctgaaaatatctgaatggccaaaggcatctgaaacacacaaaaggatcactgttattacacaaggtgctgatcctgttgttgttgctgagaatgggaaggtgaagttgttccctgtaataccgttgccaaaagagaaacttgttgacaccaatggtgctggggatgcatttgttgggggattcttgtcacaattggttcaaggaaaacctgttgaagattgtgtaagagcaggatgttatgcgtcaaatgttatcatccaaaggtcgggttgcacataccctgagaaaccagattttgcataagataagttcttattcttggtttctagttttatgttgacagaacatattcgacttctagtatttagtactcggtcgagtaattccaatttttgggctattgttcccaaaattctacccatgttgtaaggaattttgattgcccttacattatttgagatttgagaataacattgtactagaaaatttagaaaatttcttccaatttctgggctattgttcccatttgtaaggaattttgactgttttttcatatcattcgagaataacattgtattaggaaataaaaaaaaaaaaaaaaaaaaaaaa

SEQ ID NO: 127 - DNA, 565 bp, Nicotiana benthamiana
cccgttgtttcctttgtttgttgggagcttttcgaagaacaatcagccgactacaaggaaagtgtccttccatcatctgttacagctagagttagcattgaagctggatccacatttgggtgggagaaatatgtcggatcaaaggggaaggccatcggaattgatagatggggtgccagtgcccctgctggaaaaatataccaggagtacggaattacagcagaggctgttgtagctgcagctaaacaagtttcttaggctttattacttacacttggttgctggtgtctaccaaatttgttttcagtttgacactgaggttggaggtgatggtggaaaccaataccaaacggactcggcagttcactgttgcctggtattttcaataaaaactatttcttcatctgccctttgttttcttcagttttagtagcggagcggccaaaatgaatccaagatgaggatagaaataggattatggatgctcctgaccatgtacactttaaaccatatctttgagttttgtaatttcatttggtcgagtgataccaagatcttattttca

SEQ ID NO: 128 - DNA, 759 bp, Oryza japonica
ccccccaaaatacatctacattgctggctttttccttacggtctccccagattctattcagcttgttgctgagcatgctgccgctaacaacaaggtgttcctgatgaacctctctgcaccctttatctgtgagtttttccgtgatgcccaggagaaggttcttccgtttgtggactacatcttcggtaacgaaacagaagcaagaatctttgctaaagtccgtggatgggagactgagaatgttgaggagatcgcgttgaagatttcccagcttccattggcctctggaaaacaaaagaggattgccgtgattactcaaggtgctgatccagtagttgtcgctgaggatggacaggtgaaaacattccctgtgatcctactgccaaaggagaagcttgttgacaccaatggcgctggtgatgcctttgttggaggcttcctctcacaattggttcaacaaaagagcattgaggactctgtgaaggctggttgctatgccgcaaatgttatcatccagcgttctggctgcacttaccctgagaagcctgatttcaactagggctaacccaaccacatattgaggaacaattattcgcacatccaacctactagtggtttggtgtgttctacctgtaccatctcgaggctttccatatgatccggccaatatttttttgccgtgatttttgtttcactgctgcaaaccttactttattctcggtataaggcacaattgccaatcggtgtgttgttttggtc

SEQ ID NO: 129 - DNA, 647 bp, Nicotiana benthamiana
catacattttatcagacaattcttctggcagggaaacctgatgtcattttgattggtactggctcagagttagaaattgctgtcaaggctgctgatgaactcaggaaagaaggaaagacagtgagagttgtttcctttgtttgttgggagcttttcgaagaacaatcagccgactacaaggaaagtgtccttccatcatctgttacagctagagttagcattgaagctggatccacatttgggtgggagaaatatgtcggatcaaaggggaaggccatcggaattgatagatggggtgccagtgcccctgctggaaaaatataccaggagtacggaattacagcagaggctgttgtagctgcagctaaacaagtttcttaggctttattacttacacttggttgctggtgtctaccaaatttgttttcagtttgacactgaggttggaggtgatggtggaaaccaataccaaacggactcggcagttcactgttgcctggtattttcaataaaaactatttcttcatctgccctttgttttcttcagttttagtagcggagcggccaaaatgaatccaagatgaggatagaaataggattatggatgctcctgaccatgtacactttaaaccatatctttgagtttt

SEQ ID NO: 130 - DNA, 611 bp, Oryza indica
cccccgatcgcttctcatcgcaaatcgcatggacttcgattcgcttcgtttcgttctcgctgttgatttgttcgtgagatttgaattctagcaatggctcctctcggtgacggagcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggcggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcat

SEQ ID NO: 131 - DNA, 646 bp, Oryza japonica
cccccgcttcgtcctgctgatggtaacgagactgctggggcatacaaaatcgcggtgctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaagattcaaaccgcgcgttttgagtttttgtcatcgttgatgccaaggaacagtatacatgaagccatgaaggtcttgtgcccaaagcttggaataatgaagggagagggatgcctgcattgg

SEQ ID NO: 132 - DNA, 511 bp, Oryza japonica
ccccatgacattgcttaagatgttcggtgacttccaaagggatacgcctgaggagcgcaatgtccgatttggagtcagggagcatggaatgggcgccatttgcaacggcattgctctgcacagcccaggactcattccatactgggctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcatt

SEQ ID NO: 133 - DNA, 1428 bp, Oryza indica
gatggtacgcatcatcggcccaagtccagctcaatcctcctcaccaacaccaagacgaccacgacctcctcgccctcgccgccgcccaccgaccatggcctccgccgccgcttcttcctccaaacctcccgtcgtgcttggctgcggcgccgtctccgcggactacctcgccaccgtcgcctccttccccaaccccgacgacaagatccgaagcctaacgctcaaggtccagggaggcggcaacactggcaatgccttgaccgccgctgctcgtttgggccttcgcccaaggatcatatccaaggtatccaatgacccacaaggaagaaatattctcaaggagctgcaagatgatggggtcgacacctctcatatcctggttgcagaggaggggaattcacctttcacctatataattgttgacaaccagacgaaaactcgtacttgtattcacactcctggttatcctcctatggtccctgaagagctcacacaagaaaacttgtttgccgctttagacggtgctgacattgtatattttgatgtcagattgcatgaaactgctttactagttgctgaagaggcaagccaaagaaaacttcctattttgattgatgccgaacggaagagggatggattggacgagcttctcaatttcgcatcttatgttgtatgctctgcaaaatttcctcaggcttggacaggagcctcatcaacaccggttgctttggtgtccatgcttttaagattgcctaatatcaagtttattattgtaacccttggagaaaagggatgcttgatgcttgaaagaagcacaacagatgcttctgaggcagaggaaatagatgtagagagtcttctggaatcactagagaagaaagaagttttgagttcaagcatgccaaaatgcatcgcctccaagtcaaatttgagaataagtgcagatggaataggatccatcagtggcagattacttttaggcactgccgaaattataccctctgaagagctcatagatacaactggtgcgggtgatgcatttatcggagcagttctctacggtttatgctctggcatgccgcctgagaagatgctgccttttgcagctcaagtggctgcttgcgggtgcaggggtttaggggctcggactgctcttccccatcgcacagatccccgcctggttgcctattgactcgaggaactgtagtgtatcaatctgtgttggatctgattgggatggattcattggattgtgggcgcctttgaaaaataagagattaagcatttgaaatatggagtaataagaaagccgcctgcagttgaaatcggttcctaagttgtatgtaaacagtgattgttgttgcatactgtcaatataccttggcttgtgttaataagagagatttgtgtgctgttgttgcaaggccc

SEQ ID NO: 134 - DNA, 1428 bp, Oryza indica; identical to SEQ ID NO: 133

SEQ ID NO: 135 - DNA, 1172 bp, Papaver rhoeas
tttttttttttttttttgttcttttttttaattattattataattcgttcacgaggctgtttttctgaactcaaattactcttaaagacaggcctctctcctcccgtgtcacttctaaatttggaagagcagaaatccaaaaaccaaaatgacaaataagcttcagctgaaaaagggacaaagaaaacaatctacataactgacttagctgctgcaataacggcctctgatgtgatgccaaactctttgtatataattggtgcaggcgcacttgctccgaaaccgtcaacaccaatagcctttcctttgcttccgataatcttgtgccatccgaatgttgaacctgcctcaatactaactctagcagtgacagcagctggaagaacagactccttgtattcgtcggtctgttcatcatataattcccaggaaacaaatgaaacaaccctaactgcagttccttccttcctgagctcaccagcggccttttcagcaatttctaattctgaaccagtagcacacacgatgacatctggtttgttacctgtagagttgtctgatattgtgtaacctcccttggcgactccttcaatggaggttcctggaaggtttgcaagcttttgacgtgaaagggcaagaattgagggtctctttctgttttcaactgcaaccttgtatgccccggcagtctcgtttccgtcagcgggacggaacataagaatgttaggcatggctctaaagcttgccaaatgttcgatgggctgatgagttggaccatcctctccaagaccaatagagtcgtgggtcatgacgtaaatgactccagcttcagataaggctgaaattctcatggcacctctcatgtaatcggtgaaaacaaagaaggtagcacagtaggggacaaaaccaggactgtggagagcaattccgttacagatggctcccatagcatgctctctgacaccaaatcgaacattcctctcttctggagtggccttttggaaatctccgaacattttcatcaaggtcatgttggaggaagcgagatctgcactaccaccaataagaccagggaggactggagcaagtgcattaaggcatgtctgggataggtttctggtggcatcagctgggatctctggagtgtaggtaggaagagccttctcgaattc

SEQ ID NO: 136 - DNA, 580 bp, Oryza japonica
aaatcgcatcgacttcgatgcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtctccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgcca

SEQ ID NO: 137 - DNA, 717 bp, Oryza japonica
cctgtcataagttggcatcaaaacttaaccaatcaagtaaaagcacaccaaataagctgtgccactaattgattacacaagcccttgatgtatcaaggagttccaaatacaacacctagcagcagaatactaaaattaaagctacaacaggaagctttttggcttctaatattagctttgctcctcggcctcagcctccgctgccgcggcctccctctcttccgcggctgctgccatcagttcgtcaaatttgtccgtcttgcccagcactatttcaatcttggctttctgcatagggcgactcctcgaatcatctttgacgtcaacagtagatgtcataatcttcttctcgacagcaaggccattatttttcagaatttcagcaacagtcaccacagttgcaatagccatgccgagtgccgagagctccacttcgttatgcagctgcatgtacctcttggcgaggttgacgtagaagaagagcggcttcttggtgttggagacctggatgcggttcttcttgtgcgcctccgccgcgccgccgcccgccccggcggcttctcccgcggctatggtgaggttgccgaccgcctccgtcacctcctccatggccgccgcccgacgagtccccgcggagcaccgtgcgcgagtgaaacggagagcgcgaggcggcgaagaagatgtggaggatttcggcggcgacggaggtaagaggga

SEQ ID NO: 138 - DNA, 630 bp, Oryza japonica
cccccctcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaagattcaaaccgcgcgttttgagtttttgtcatcgttgatgccaaggaacagtatacatgaagccatgaaggtcttgtgcccaaagcttggaataatgaagggagagggatgcctgcattggagcgtgagtggtattttaggcctgtaataagcactgcttttccatttacgtttgttttgttggatcactccttagatgattcatcaagttgagcctgattcaattggggactggttttggtaatatttacatttgactatagtccagctacaatattccgttctccct

SEQ ID NO: 139 - DNA, 622 bp, Oryza japonica
cccccctcattgtgatgagcactggctgtgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaagattcaaaccgcgcgttttgagtttttgtcatcgttgatgccaaggaacagtatacatgaagccatgaaggtcttgtgcccaaagcttggaataatgaagggagagggatgcctgcattggagcgtgagtggtattttaggcctgtaataagcactgcttttccatttacgtttgttttgttggatcactccttagatgattcatcaagttgagcctgattcaattggggactggttttggtaatatttacatttgactatagtccagctacaatattccg

SEQ ID NO: 140 - DNA, 642 bp, Papaver rhoeas
gaattcaagagccattggagccgccatactgctgaaggtgctgccctagaagctgaatggacagctaaatttgcagagtacgaaaagaagtactcagaggatgctgcagaatttaagtccatcattactggtgaattccctgctggttgggagaaggctcttcctacctacactccggagatcccagctgatgccaccagaaacctatcccagacatgccttaatgcacttgctccagtcctccctggtcttattggtggtagtgcagatctcgcttcctccaacatgaccttgatgaaaatgttcggagatttccaaaaggccactccagaagagaggaatgttcgatttggtgtcagagagcatgctatgggagccatctgtaacggaattgctctccacagtcctggttttgtcccctactgtgctaccttctttgttttcaccgattacatgagaggtgccatgagaatttcagctttatctgaagctggagtcatttacgtcatgacccacgactctattggtcttggagaggatggtccaactcatcagcccatcgaacatttggcaagctttagagccatgcctaacattcttatgttccgtcccgctgacggaaacgagactgccggggcatac

SEQ ID NO: 141 - DNA, 626 bp, Papaver rhoeas
gaattcaagacagatacagcattagttgataaatgagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccacgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatac

SEQ ID NO: 142 - DNA, 546 bp, Papaver rhoeas
gaattcagaagaagaacagaggagaaggaaaaaaggaatcaatcctttattccgataatagcctcaatcatggcagcatcttcatcccttacagtatcacaagccctagttggcaggaaaatctctggtattaacacttcttctcgttcacaatcattacctggattcagtctaagtactttatcaggaagaacattgaaatcttcattgatttcatcgattgcatcatcacgatctaatcgtgtcaatacaccatcgttatcgagatcgttggtggtccgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaatcatgagatataaccctaagaacccttactggtttaacagagatagattcgttctttctgctggtcacggttgtatgttgcagtatgctttgcttcatctt

SEQ ID NO: 143 - DNA, 705 bp, Papaver rhoeas
gaattcaagacagatacagcattagttgataaatcggtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccacgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatacccgttttgaaggtctaggatggcacgtaatttgggtgaagaatggtaacaatggttatgatgaaattcgtgctgccatc

SEQ ID NO: 144 - DNA, 543 bp, Papaver rhoeas
gaattcaagaataagaacagaggagaaggaaaaaggaaaatcaatcctttattccaaaaggccactccagaagagaggaatgttcgatttggtgtcaaagagcatgctatgggagccatctgtaacggaattgctctccacagtcctggttttgtcccctactgtgctaccttctttgttttcaccgattacatgagaggtgccatgagaatttcagctttatctgaagctggagtcatttacgtcatgacccacgactctattggtcttggagaggatggtccaactcatcagcccatcgaacatttggcaagctttagagccatgcctaacattcttatgttccgtcccgctgacggaaacgagactgccggggcatacaaggttgcagttgaaaacagaaagagaccctcaattcttgccctttcacgtcaaaagcttgcaaaccttccaggaacctccattgaaggagtcgccaagggaggttacacaatatcagacaactctacaggtaacaaaccacatgtcatcgtgtgtgctact

SEQ ID NO: 145 - DNA, 687 bp, Papaver rhoeas
gaattcaagaacattgaaatcttcattgatttcatggattgcatcatcacgatctaatcgtgtcaatacaccatcgttatcgagatcgttggtggttcgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccccgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagatggatgtcaaatggagggaattgcaaatgaagcttgttcgctagctggacattggggacttggaaagctgattgctttctacgatga

SEQ ID NO: 146 - DNA, 591 bp, Papaver rhoeas
gaattcacattgaaatcttcattgatttcggcgattgcatcatcacgatctaatcgtgtcaatacaccatcgttatcgagatcgttggtggttcgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaatccctggtcaccccgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattctt

SEQ ID NO: 147 - DNA, 612 bp, Papaver rhoeas
gaattcaaagctgattgctttctacgatgacgaccacatctctattgatggtgacacagagattgctttcacagagagtgtagatacccgttttgaaggtctaggatggcacgtaatttgggtgaagaatggtaacaatggttatgatgaaattcgtgctgccatcaaggaagcaaagtctgtcacagacaagcccactttgatcaaggtgactaccaccattggttttggttctccaaacaaggcaaactcatacgccgtacacggtgctgcattgggttctaaagaggttgatgccacaaggaagaaccttgactggccatttgagcctttccacgtgccagaggatgttaagagccattggagccgccatactgctgaaggtgctgccctagaagctgaatggacagctaaatttgcagagtacgaaaagaagtactcagaggatgctgcagaatttaagtccatcattactggtgaattccctgctggttgggagaaggctcttcctacctacactccagagatcccagctgatgccaccagaaacctatcccagacatgccttaatgcacttgctccagtcctccctggtcttattggtggtagtgc

SEQ ID NO: 148 - DNA, 583 bp, Papaver rhoeas
cagagatagattcgttctttctgctggtcacggttgtatgttgcagtatgctttgcttcatcttgctggttacgacagtgttacgacagaagatttgaagactttccgtcagtggggaagcaaaattcctggtcaccccgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatacccgttttgaaggtctaggatggcacgtaatttgggtgaagaatggtaacaatggttatgatgaaattcgtgctgccatcaaggaagcaaagtctgtcacagacaagcccactttgatcaaggtgactaccaccattggt

SEQ ID NO: 149 - DNA, 629 bp, Oryza japonica
cgatcgcttctcatcgcaaatcgcatcgacttcgattcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcatcctctgctcctacgacccc

SEQ ID NO: 150 - DNA, 934 bp, Arabidopsis thaliana
ctcaatggagtacaaacatttcagccatccacacactctaaaactccaacagattcagccacataaaagctcagattcttcagtaatctgctcaggttgtgaatcagccatctctgaatccgaaaccgcgtatatctgttcaacatgtgacttcaatcttcatgagcaatgtggtaacgcagtgcgtgggatgcaacatccttctcacgctggtctccaccacttgactctagtcccttacacaacttacagcgctggtaccttcctctgcagagcctgtggctgcactggaggtaaagggttctcttactgttgtcctttgtgtgactttgaccttcatgttcaatgcgctcacctgcctcaggtcttggttcatgagtctcatcctatgcatagtcttcttcttgtctacaacagtactcctcctatgtcttttactcagtttggtttcgggaatcagcttgtttgcaatctttgtaatatgactatggatggtaggttttggtcttacaactgttatgcttgtaactatcatattcatgcttcatgtgctgtgaataagcccaatccagtggctgcttctgctgagaactgtggggcgagtgatgaaggaaagacaccgactgctgaatctgttcctgttcagggtttggagactgagcagacggaacaagtagctgcaataacagagcaagtggaagatccagttttgaggcaacagcttgagcttcagaagcttcagcttgagctagatatgagttctgctctcgcaaacatgattggttccttcaatctcagttctttcgtttgaagtgtctttgtgtttcagtttgtttgattttatgcatttacatgtgttgaattgtctctgttcttgtgttccctaatgtgcttctgatttgaataaatatatcctatctatttggtttaaaaa

SEQ ID NO: 151 - DNA, 727 bp, Arabidopsis thaliana
ctctttccttctctcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggtttctacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaatcttcagtgtagtaaaacaaatgtaaattttttaattatggagtttcacttgttttttaattagattatatatagtcgacgcccatctaattcccattttag

SEQ ID NO: 152 - DNA, 903 bp, Artificial Sequence
  Synthetic
ttaaaccaaagcatactcttttgccagagaatcatcaagacatgacgattatttcaatggtgactctatcagggaaccaagaaactatgataacaatttggaagctcctacaagaaacactctggtacaatccctccaatggagagagaaaacacctactcaggacaatccaatctttgaaacctcccagtcctccagagtcaggcgcccacctcttgagagacagcagtcgacactctaaccctcacaacttcgcctctcatcccaactacagaagccgtaatgggagaactctgtgatgtcactattcaatacacgagctgcgccgatcctagcaattccctctccttttgataaccatttctctgtagaacagcctctctctcctgatgtgccagtacatcctgctcagatacaacagatccctccgatcccaccaaagaaaaagaagggccgacctccacttacaaaacctattagacgccatggtgatgactctgtcagcacttcaagtaaatcctcttctcagagacgacaacacaccagggttgcagcaaatctggcttcttcaagcaaagctcctcctacaaggccaattatcccagccactgtgaaaggaagggtggattttcccaatccacctcctcctcttccttaaaacttgcaagctggaactgctgtgggctggggaatcccatgacagttcaacgactgagagagattcagaaaacaatctctccagacatcctattcctcatggagacgaaaaaccctgatgaagtggtgcttaaaaaacttcaatggtcgaatttctcaaaccatttactcatatctccgcacagccctgggggtggaggcctggccctctactggaaacaacacatcgagctagaagtactctcc

SEQ ID NO: 153 - DNA, 714 bp, Artificial Sequence
  Synthetic
ttgttttttttttgttttttttttttttttttttttaagaaaggcgatttgctcaccataatcacaacatattcaagaaccaaagacaacgaggtgacataaaaaaacaccaaaaaagggactcaaaacatgaagaaacaaaagagaagaaacaagaaacttgaagaaacaaggccattaactccgaatgcataagctcctgagttagtagttgttaaaagagaatagccgccttccggtgtgtttgtagtgaggatgacaacaacccaaatatcaccagaaccaataccaattccagtgatcttagaatcattcaagttcttgagtacgacactgttgaaattgctcaagtcagggttcttatcatgcttaggaaaacagacttgcatgatcacaccgtctctgactacggttgtgttgagactgcatttagcgaggaggttatttccagggactggagctgagttattagtgtttgtgcagggttggttctttagttggtctacgacttcgtctgcgagacattctgcgttttcgttctttgttaaggtttttaggtttagtcctgttctgtatttgttgaatactgtaagaagaaggtcttcttctccatcggtgccggaaagaacaagacgatgaagggagagaaagactgagagaagacagagtagatggagtttggaaatcgccattgatgcagaggttttttttttt

SEQ ID NO: 154 - DNA, 693 bp, Artificial Sequence
  Synthetic
  misc_feature (594)..(594): N at this position can be a, c, t, or g.
gaaggtgataaggagcatttgatgtctgaaatgaactttgagaaaacatttgggcaatcatccatctttgtaacctcaactttgatggaagaaggtggtgttcctccgtcatcaagtcctgcaggtaccggtccggaattcccgggtcgacccacgcgtccgcttatccgttaaaaagactagaaaaagggatcaaccaaaccaaaccaaaaaaaaaagtaaccatctttctcctaaatctctacaatggctcgatctttatctccatcactttctctctctcggtgccgtttcgccgcagcttctcttcttctcccttcatctcaaaccattttcatccgatctcaatcctcgaatcgtcggtctaactctaaccatctcggagtaatctacgagattgatatcgctgcggatcctcttgtcaataagttggaagatgctgtccaccggattatggtacgccgatccgcacctgattggctcccttttgttcccggtgcttccttttgggttccacctcctagatcccagtctcatgggatcgctaagctcgttgagaagctggccaatccgatctctgatgaagaatctatntcaatctcatcggttcgaggatggccttgctctgatacttcataaaggtgtaagcctcatcagtgagacgagatgactcatactgatatactcgagacg

SEQ ID NO: 155 - DNA, 633 bp, Arabidopsis thaliana
ggaaaacaatcacctggttgtttgtttcggggagttgttgattgacttcgttcctactgtatctggagtttcacttgcagaagcgcctggatttgagaaagctcctggtggagctccagctaacgttgcagttggtatagcaagattaggaggttcttccgcctttattggcaaggtgggtgcagatgaatttggttatatgttatctgatatattaaaacagaaccatgtcgacaattctggcatgcgtttcgatacccatgcaaggacagcattagcatttgtcactttgagagcagatggcgagagagaattcatgtttttccgcaatccaagtgctgatatgcttcttacaaaggaagagctggacaaagatctcattcagaaggcaagaatatttcactatgggtcaatctctttaatcgcggaaccgtgtaggtcagctcatcttgcagccatggagattgccaaaaaagctggctgcattctctcttatgacccaaatctaaggttgcccttatggccatccgcagatgctgctcgtaaaggcatcttgagcatttgggaccaagccgacgttattaaggtaagcgaagacgaaatcacattcttgacagacggtgaagacgccta

SEQ ID NO: 156 - DNA, 1127 bp, Oryza japonica
ccccatgacattgcttaagatgttcggtgacttccaaagggatacgcctgaggagcgcaatgtccgatttggagtcagggagcatggaatgggcgccatttgcaacggcattgctctgcacagcccaggactcattccatactgggctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattcysmygcttcgtcctgctgatggtaacgagactgctggggcatacaaaatcgcggtsctcaacaggaagaggccatccgtccttgctctctccaggcaaaagcttgctcagctgcctggtacctcgattgagggtgttgagaagggtgggtacatcgtctctgacaactcaactggcaacaagccysmcytcattgtgatgagcactggctgtgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaagattcaaaccgcgcgttttgagtttttgtcatcgttgatgccaaggaacagtatacatgaagccatgaaggtcttgtgcccaaagcttggaataatgaagggagagggatgcctgcattggagcgtgagtggtattttaggcctgtaataagcactgcttttccatttacgtttgttttgttggatcactccttagatgattcatcaagttgagcctgattcaattggggactggttttggtaatatttacatttgactatagtccagctacaatattccgttctc

SEQ ID NO: 157 - DNA, 1990 bp, Papaver rhoeas
gaattcagaagaagaacagaggagaaggaaaaaaggaatcaatcctttattccgataatagcctcaatcatggcagcatcttcatcccttacagtatcacaagccctagttggcaggaaaatctctggtattaacacttcttctcgttcacaatcattacctggattcagtctaagtactttrwmwgvaagaacattgaaatcttcattgatttcatcgattgcatcatcacgatctaatcgtgtcaatacaccatcgttatcgagatcgttggtggttcgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccccgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatacccgttttgaaggtctaggatggcacgtaatttgggtgaagaatggtaacaatggttatgatgaaattcgtgctgccatcaaggaagcaaagtctgtcacagacaagcccactttgatcaaggtgactaccaccattggttttggttctccaaacaaggcaaactcatacgccgtacacggtgctgcattgggttctaaagaggttgatgccacaaggaagaaccttgactggccatttgagcctttccacgtgccagaggawktyaagagccattggagccgccatactgctgaaggtgctgccctagaagctgaatggacagctaaatttgcagagtacgaaaagaagtactcagaggatgctgcagaatttaagtccatcattactggtgaattccctgctggttgggagaaggctcttcctacctacactccagagatcccagctgatgccaccagaaacctatcccagacatgccttaatgcacttgctccagtcctccctggtcttattggtggtagtgcagatctcgcttcctccaacatgaccttgatgaaaatgttcggagatttccaaaaggccactccagaagagaggaatgttcgatttggtgtcagagagcatgctatgggagccatctgtaacggaattgctctccacagtcctggttttgtcccctactgtgctaccttctttgttttcaccgattacatgagaggtgccatgagaatttcagctttatctgaagctggagtcatttacgtcatgacccacgactctattggtcttggagaggatggtccaactcatcagcccatcgaacatttggcaagctttagagccatgcctaacattcttatgttccgtcccgctgacggaaacgagactgccggggcatacaaggttgcagttgaaaacagaaagagaccctcaattcttgccctttcacgtcaaaagcttgcaaaccttccaggaacctccattgaaggagtcgccaagggaggttacacaatatcagacaactctacaggtaacaaaccasatgtcatcgtgtgtgctactg

SEQ ID NO: 158 - DNA, 607 bp, Oryza indica
cgatggtacgcatcatcgggccaagtccagctcaatcctcctcaccaacaccaagacgaccacgacctcctcgccctcgccgccgcccaccgaccatggcctccgccgccgcttcttcctccaaacctcccgtcgtgcttggctgcggcgccgtctccgcggactacctcgccaccgtcgcctccttccccaaccccgacgacaagatccgaagcctaacgctcaaggtccagggaggcggcaacactggcaatgccttgaccgccgctgctcgtttgggccttcgcccaaggatcatatccaaggtatccaatgacccacaaggaagaaatattctcaaggagctgcaagatgatggggtcgacacctctcatatcctggttgcagaggaggggaattcacctttcacctatataattgttgacaaccagacgaaaactcgtacttgtattcacactcctggttatcctcctatggtccctgaagagctcacacaagaaaacttgtttgccgctttagacggtgctgacattgtatattttgatgtcagattgcatgaaactgctttactagttgctgaagaggcaagccaaagaaaacttcctat

SEQ ID NO: 159 - DNA, 452 bp, Arabidopsis thaliana; identical to SEQ ID NO: 7

SEQ ID NO: 160 - DNA, 391 bp, Arabidopsis thaliana
attaggaataaggcgcgtgctttccaggttctgcgagcaaaactgtatgaaataaaagtaagggaacaacaagagaagataaggaatgaaaggaaatctcaggttgggactggagctcgttcagaaaagataagaacatacaattataaggacagtagagtgactgatcataggctaaagatgaactttgcgcttacaacatttcttgacggtgctttagaggacgcagtgcaggcttgtgctgctttggagcaaaaggaactcatggaagaactctccgagtctgtagctgcttcttctgctacttctggataaatcctcaaactatactccaaggaaaactttgtagttgtacacacatcataattataagacttttattcattcaaaa

SEQ ID NO: 161 - DNA, 397 bp, Arabidopsis thaliana
atagacatgtttcttcgcggtcaccacatagggagcattctcagcacaagaacactctctactcttctcatgacaaatccaggtcgaagcggtcaaggtccagatcaagatccccccacaggcgccatcgtaaatgaacactctagcaaactggtctgagactgtacccgggacaatattgtgcgcggtggatcacaggattgggttaatgtactggacggacatcgatataatcaaaaactataaagtcaccggtttgtgagcgaaatagtgcatagtaaaccgctctttccttagttcttcagaagaaatatccaaagatttttgactgacttgtttgacaatatcgttggttggttaagcgttcctatgtaaaattttgttccctctgaaaaaa

SEQ ID NO: 162 - DNA, 800 bp, Arabidopsis thaliana
gtacaatgtctcctatgtctaccatgccctagatgcctacatcgagagagacaatgtcggcttgaaaggtttcaccaagtcagtttctttagtctaaaggaaaaccgtatttgtgtctcttcagctggtggatcatctttttgttattgttgagggtttaacgctaataggttctttaacgattcaagtcttgaagaacgaggttatgctgagaagtttatggagtatcagatgcattgtttgcgatggagcttgcactgactttggagaaacttattaatgaaaagcttctgaagttacaaagtgttggtgtgaagaacaatgatgttaagctggttgattttgtagaatctgagtttctaggcgagctggtcgaagccatcaagaaaatctcagagtacatagatggaacaaaaataaggtcaatgcagtggtgaagctgagatcggatgtttctgatataagctggcaagtgaagatggagggtcaaagactaacccaaggctggcaaaagttcgcaacaagccacgatctccgagtcgtcgacatagttgttttcagacatgatggagatttcttctcaaaactttgaattctttgaattctttgtttcgagatctatcgatactcgacatcaaagaactccttataactcttgattcattgaaacaagagtaggcatgtcaatcgagctatcccggtccgacccgaaacccgtaatacccgtatatgtttgagtttgggtcagaaaagctctgagcctatattttaaattaggtatttcctggattttttatttt

SEQ ID NO: 163 - DNA, 578 bp, Arabidopsis thaliana; identical to SEQ ID NO: 69

SEQ ID NO: 164 - DNA, 771 bp, Arabidopsis thaliana
agaaacgatgagttctcagatttcggagattgracaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatagcgtaaaaggctaaaactccacccactagatatcggatcgtatcttataaaccatataatatacgaatacgattaataatatatcaaaaagattggaaataggtgtgctttttgaaattagtgagcgttttttatggaaaagaaaagaaaagaaag

SEQ ID NO: 165 - DNA, 633 bp, Oryza japonica
cccccgatcgcttctcatcgcaaatcgcatcgacttcgattcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcatcctctgctcctacgacccc

SEQ ID NO: 166 - DNA, 581 bp, Arabidopsis thaliana
aaagacgctgaagaagaactttgccaacaagkgkcttaacgctaaagaccttgtggttctctcagggggtcacaccattggaatctctagttgcgctctcgtcaacagtcgtctctacaacttcacaggaaagggcgattctgacccatccatgaaccctagctacgtgagggaattgaagagaaagtgcccgcctacagatttcagaacctcactgaacatggacccaggcagtgcgttgacattcgacactcactacttcaaggtcgtggctcagaagaaagggctcttcacatctgactctacgcttctcgatgacattgagaccaaaaactacgttcagactcaggccattctccctcctgtgttttcttctttcaataaagatttctccgattccatggtcaaacttggtttcgtccaaattcttaccggcaaaaatggtgagatcaggaagagatgcgccttccctaactaatttggatcgatcagaccgggtttcggatgattttgagtctacacgtttttctctgcttattttctttctttttcttttttctttcacggaagtttgagctttg

SEQ ID NO: 167 - DNA, 701 bp, Arabidopsis thaliana
gatatgagtagccaaatcgctttgtcaccggssrtcgccgccgccattcgccgtccgtcctctcacgactgtctatccgcttccgccactactgctaccgccacccccatggctctcaaatcttgcatcgtcgcacctctctcgctattcacctctcaatctcaaatcaaacactcaagctcaagaaaaacttctcgaaccacgattcgatgcgatgtagcgataaaatccgcagattcgataaacgcagacgccaatccttcgtcctcaccgtcatcagaggaagaaatcgaagcggaagcgaaggcgaagataggatctagggttagagtaactgcaccgttgaaggtttatcatgtaaatcgagttccagaggttgatttagaaggtatggaaggtaaactcaaagattacgttgctgtttggaaagggaaacgaatctcagctaatcttccttataagattgagttcttcaaagaaattgaaggtcgtggtcttgttaaatttgtttcacatcttaaggaagatgagttcgagttcattgatcagtgatgaaacaagaaagacaatttttgttttcctttctcagtgtttgtttttgtttgttgtgtttactggaacctgggaatggagaatgatttgtatgtagtgtgatgtgtattcaacctttagcaatcatatacataagggtttcttcaaaa

SEQ ID NO: 168 - DNA, 693 bp, Nicotiana benthamiana
catacattttatcagacaattcttctggcagggaaacctgatgtcattttgattggtactggctcagagttagaaattgctgtcaaggctgctgatgaactcaggaaagaaggaaagacagtgmsmgttgtttcctttgtttgttgggagcttttcgaagaacaatcagccgactacaaggaaagtgtccttccatcatctgttacagctagagttagcattgaagctggatccacatttgggtgggagaaatatgtcggatcaaaggggaaggccatcggaattgatagatggggtgccagtgcccctgctggaaaaatataccaggagtacggaattacagcagaggctgttgtagctgcagctaaacaagtttcttaggctttattacttacacttggttgctggtgtctaccaaatttgttttcagtttgacactgaggttggaggtgatggtggaaaccaataccaaacggactcggcagttcactgttgcctggtattttcaataaaaactatttcttcatctgccctttgttttcttcagttttagtagcggagcggccaaaatgaatccaagatgaggatagaaataggattatggatgctcctgaccatgtacactttaaaccatatctttgagttttgtaatttcatttggtcgagtgataccaagatcttattttcaattgg

SEQ ID NO: 169 - DNA, 504 bp, Arabidopsis thaliana
gctagtgggagaatccggttgcatcccggagatcgtgaaacttctggaatcgaagtcmaacggatgtcgagaagcggcggctcaggcgatcgctggattggtagcggaaggaaggattcgacgggaactgaagaaagacgggaagagcgttctgacgaatttggtgatgttattggattcaaaccctggaaacacggcgaagaagtacgccgtggcggggctgttggggatgtcgggaagcgagaagagtaagaaaatgatggtgtcgtacggagcaatagggtatctgaagaagctgtcggagatggaagtaatgggcgccgataagcttctcgagaagcttgaaagaggaaagctaakaagcttctttcaccggtaaaacgaacgatgcggagacattgaagcagccaagataaaaagtgtaatattgtctgatgtaagtttattaaccgttagttaaactttactagtaattaaaaagtgttctttgggctgammaaaaaa

SEQ ID NO: 170 - DNA, 1626 bp, Nicotiana benthamiana
gcttcttcttcttctctcactctctctcaagctatcctctgtcgttcagtccctcgccatggctctgcctcttcttctcaactttccccttcttctctcactttttccggccttaaatctaaccccaatatcaccacctcccgccgccgtactcctccctccgccgccgccgtacggtcatcgacgattcgtgcatcggctgcaaccgaaactatacagaaaactgagactgcccttgttgacaaatctgtaaacactattcgatttttggctattgatgctgttgaaaaggcaaattcgggtcaccccggtttgcccatgggttgtgctccgatgggtcatatactgtacgatgaggttatgaggtataacccgaaaaatccgtattggtttaatcgggatcggtttgttctatcagctggacatggttgtatgcttcagtatgctttgcttcatctagctggctatgatgctgtcaaggaagaggacttgaagagcttccgtcagtggggaagcaaaacccctggacaccctgaaaactttgagacacctggtgktgaagtcaccaccgggcctctgggacaaggtattgccaacgccgttggcttggcccttgcagagaaacacttggctgctcgcttcaataagcctgacgctgagattgtagaccactacacatatgttattctcggtgatggttgccagatggagggtatttcacaagaagcttgttcacttgctggacactggggacttggaaagctgattgctttctatgatgacaaccacatctcaattgatggtgacacagaaatcgctttcactgaggatgttggtgcccgttttgaggctcttgggtggcacgtaatctgggtgaagaacggtaacactggttatgatgagattcgtgctgctattaaggaagcaaaagctgtcacagacaaacccactatgatcaaggtgactacaaccattggttttggctcgcccaacaaggcaaacagttacagtgtacatggaagtgcacttggagctaaggaagtagaggccaccaggagtaacttgggatggccttatgagccgttccacgtgcctgaagatgtcaagagccattggagtcgtcatgttcccgagggtgctgctcttgaagytggatggaataccaagtttgctgaatatgagaagaagtacccmgaggaagctgcagaactcaaatccattrycactggtgaactamctgctggctgggagaaagctctgcctacctacacacctgaaagtccagcrgatgccaccagaaacytgtcccaacaaaacctgaatgctcttgccaaggttctccctggtttccttggtggtagtgctgatctcgcctcatcaaacatgactctcatgaaaatgtttggtgacttccaaaagaacaccccagaggagcgtaatctaaggtttggtgttcgtgaacatggtatgggagctatatgtaatgggattgctctacacagccctggcttgattccctactgtgctactttctttgtgttcactgactacatgagaggagcaatgagaatttcagccttgtctgaggctggagttatttatgttatgacccacgattcaatcggt

SEQ ID NO: 171 - DNA, 649 bp, Nicotiana benthamiana
cttttcttctttattgtatagatatatactttacatttayacatrtattctctctattcatmgtcgstatggcagctaacggcgttagttctggtttaattgtgagcttcggcgagatgttgatcgatttcgtgccgacggtctccggygtwtcccttgccgaggctccgggtttcttgaaggctccyggmggtgcaccggcaaacgtcgccatcgcagtgactaggctygggggaaagtcggcgttcgtygggaaactcggcgacgatgagttyggccacmtgctcgccgrgatactmaaamaraacggcgtycaagcsgacgggatcaacttygacaagggmgcgagaacggcrttggcattcgtgaccctacgcgccgacggagagcgtgagttcatgttctacaggaatcccagtgcygatatgttgctcactcccgrcgagttgaatcttgatgttattagatctgctaaggtgttccactacggttcgataagtttgatagtggagccatgcagatcagcacatttgaaggcratggaagtggcaaaggaggcaggrgcrytgctctcttatgacccaaacctccgwttgccgctgtggccgtcggcagaggaggcgaggaagcaaatcaagagcatctggga

SEQ ID NO: 172 - DNA, 487 bp, Artificial Sequence
  Synthetic
tatctcctcaacttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacagttggaagacggcagaaccctagccgactacaacattcagaaggaatcaactcttcacttggtactccgtc

SEQ ID NO: 173 - DNA, 558 bp, Artificial Sequence
  Synthetic
ttctgaagttccattaatattatctcaagaagaaaaatgggttacttcgtctaaagataaaatcaaaaccaacagagagtttagaacaaaagtgaatagataaactacagctcctgagaaatgataatggcgattccttccgatacttcttgaaatctatcctcctcatatgttgctagggtacatgaagactctgactctagctcccattgacttgggtggtaggtttgaagtgaacttagaacggacaacaccgctgttaccatgaggcctagtgactttgccccaaatgcaacggtagtgagaaccgttcttctttgtctttgccttgtagatgtaagccaaacgcttacccttgtaccaattgacctcctcttgagtgttcacaccttcaatctggatgagagaagtgttgggatattggttcgacttggacctcttgtagccgaggactgttccacgaacatacaatctaactctctctccttgacgtcccttcattttcaatccttgtaactctcgtcttcctcttcttactctcttttacggacgcgtggg

SEQ ID NO: 174 - DNA, 484 bp, Artificial Sequence
  Synthetic
cggacggtgggctgcaatcgtctgaggcttcagagkgatttstctcagttatccgctctcttcttgcagcagccatgattatttcagagaaaaaccgtagagagatctccaaatacctcttccaagagggagtatgctatgccaagaaggactacaacttggcgaagcatccattgatcgatgtgccgaacctccaggtgattaagcttatgcagagcttcaaatctaaggagtacgtccgcgagacgttcgcctggatgcactactattggtaccttaccaatgatggtattgagttcctcaggacttacttgaaccttccttctgaaattgttcctgctactttgaaaaaatctgctaagcctcttggtcgtccaatgggtggacctcctggcgatcgtccgcgtggaccaccaaggttcgagggtgataggccaaggtttggtgatagggaaggctatcgtgctggaccaagaggtccacc

SEQ ID NO: 175 - DNA, 559 bp, Artificial Sequence
  Synthetic
cccccccccgaaccacaaactagggttattggcttgctgtttcagtatctattgagcttctctctaccaatcccagcsgamgcswkgggtcgaggagaaagactagggagccaaaggaagagacagtaacacttggaccagtaaccagggagggtgaattggtgttcggtgttgctcacatttttgcctctttcaacgatacttttattcatgtgactgatttgtctggaagagaaactatggttcgcattactggtggaatgaaggtaaaggctgatagagatgaatcttctccatatgctgccatgcttgcagctcaagatgtgtcacagcgatgcaaggaacttggaattaatgctcttcacattaagcttcgggctacaggaggcaacaagactaagactcctggtcctggtgcccagtctgctcttagggctttggctcgatctggcatgaaaattggacgtatagaggatgtgactccaattcccacagatagcactcgcagaaagggtggtagaaggggaaggaggctgtgaagatggttcgtttctgcagc

SEQ ID NO: 176 - DNA, 583 bp, Artificial Sequence
  Synthetic
ccagttttgttagtttgaagtgaagagcagggcatcttgggcaactcttgctgcagtacagcccacaactgccgtcaatgggctagctggaagctccattattggaactaagctacatgttaaatcatctcgccttaatttgaagtctactaaatccagggctggttctgtggtagcaaagtatggwgacaagagtgtatactttgatttagaggacytgggmaacaccactggscartgggacttgtatggttcagatgcaccttcaccatacaayycccttcagagcaagtttttcgagacttttgctgctcctttcactaagagaggtctgttgctcaaattcctgatattgggaggtggctcaactcttgcatacttcagttcaacwgcatcagsggatataytaccaatcaagaaaggacctcaacttccacccaagcttgggccacgcggaaagatctaatttcttttcaatccaactttctcaaccttcattttgtaattgatgtatctgtcaccagcttgtaagtattcttgaagcctacctgagacctttgttacagaagttaaatcttattgc

SEQ ID NO: 177 - DNA, 500 bp, Artificial Sequence
  Synthetic
aacagagaaaaattctctccgataatgttggtttatcmsgatcttctctccggkgatgagctccttkcggattcatttccstacactgaacttgaraatggagtgctttgggaagtacaagggaagtgggttgttcagggagctgttgatgtgaacatyggggckaatccatctgctgaaggygcasatgaagaygaaggtgttgaygatcaagccatcaaggttgtygatattgwtgacactttcaggcttcaggagcaaccttcttttgacaagaagcagtttgttgcctacatgaagaaatatatcaagarcctaacacccaagttaggcgcagagcaggaagaagtttttaagaacaacattcaaggagcmaccaagtaccttttgtcaaagctcagtgaccttcaattctttgttggtgagagcatggctgatgatactggaatggtgtttgcctactacaaggatggcgccactgatccaacctttttgtacct

SEQ ID NO: 178 - DNA, 567 bp, Artificial Sequence
  Synthetic
gaattctgaaaatagttttggtagtttggagtgaaaagccatggcatctttggcaacctttgctgcagtgcagcccactaccaatgtcmmrsgcstmgckggaagctccattactggaactaarcttcatstcaaatcatctcgcctcaatttgaagmccactaaatccagggcyggcyctgtggtygccaaatatggtgacaagagtgtatactttgatttggaggatttgggcaacaccactggccagtgggacctgtatggatcagatgcaccttcaccatacaactctcttcagagcaagttctttgagacatttgctgctccattcaccaagagaggtcttttgctcaaattcttgatattgggaggtggctccacccttgcytacttcagttcgacagcatcaggggatatcctaccaatcaagaaaggtccacaacttccacccaagctcggmccacgtggcaagatctaattaatttttgatccaattatcaaccttctatttgtaattgatgtatgtttcccagtttgtgtaagtatgtataattggagactttccat

SEQ ID NO: 179 - DNA, 678 bp, Artificial Sequence
  Synthetic
cccacgcgtccgccacgcgtccgcggacgcgtggggccgtgggttccaaagtttccccagccgatgctgcttatggagaagctgcaaatgtttttggtaagccaaagcaaaacactgatttcttggcgtacaacggagatggattcaagttgcaagtcccagctaaatggaaccccagcaaagaagttgagttccctggtcrmswtywcrgmyrkggaagacaactttgattccaccagcartctcattgtcactgtcactccaactgacaagaaatccatcactggctatggctcccctgaagagttcctctctcaagtggactttttgctaggaaagcaagcttactttggtaaaactgattcagagggtggatttgaatctggtgcagtggcaactgcaaacctattggaggcatcaagcacaactgtgggaggaaaagagtactatatcttgtcagtattgacaagaactgcagatggagatgaaggtggtaagcaccagttgatctcagctacagtaaatgatggcaaactttacatctgcaaagcacaagctggtgacaagagatggtttaagggtgctaggaagtttgtggagaatgcagccacttctttcagtgttgcttaagaatggaaataaagtaaaaccattagtattaagtttgtatgtacttag

SEQ ID NO: 180 - DNA, 739 bp, Artificial Sequence
  Synthetic
cccacgcgtccgctctttccttctctcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggtttctacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaatcttcagtgtagtaaaacaaatgtaaattttttaattatggagtttcacttgttttttaattagattatatatagtcgacgcccatctaattcccattttag

SEQ ID NO: 181 - DNA, 1990 bp, Artificial Sequence
  Synthetic
gaattcagaagaagaacagaggagaaggaaaaaaggaatcaatcctttattccgataatagcctcaatcatggcagcatcttcatcccttacagtatcacaagccctagttggcaggaaaatctctggtattaacacttcttctcgttcacaatcattacctggattcagtctaagtactttrwmwgvaagaacattgaaatcttcattgatttcatcgattgcatcatcacgatctaatcgtgtcaatacaccatcgttatcgagatcgttggtggttcgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccccgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatacccgttttgaaggtctaggatggcacgtaatttgggtgaagaatggtaacaatggttatgatgaaattcgtgctgccatcaaggaagcaaagtctgtcacagacaagcccactttgatcaaggtgactaccaccattggttttggttctccaaacaaggcaaactcatacgccgtacacggtgctgcattgggttctaaagaggttgatgccacaaggaagaaccttgactggccatttgagcctttccacgtgccagaggawktyaagagccattggagccgccatactgctgaaggtgctgccctagaagctgaatggacagctaaatttgcagagtacgaaaagaagtactcagaggatgctgcagaatttaagtccatcattactggtgaattccctgctggttgggagaaggctcttcctacctacactccrgagatcccagctgatgccaccagaaacctatcccagacatgccttaatgcacttgctccagtcctccctggtcttattggtggtagtgcagatctcgcttcctccaacatgaccttgatgaaaatgttcggagatttccaaaaggccactccagaagagaggaatgttcgatttggtgtcagagagcatgctatgggagccatctgtaacggaattgctctccacagtcctggttttgtcccctactgtgctaccttctttgttttcaccgattacatgagaggtgccatgagaatttcagctttatctgaagctggagtcatttacgtcatgacccacgactctattggtcttggagaggatggtccaactcatcagcccatcgaacatttggcaagctttagagccatgcctaacattcttatgttccgtcccgctgacggaaacgagactgccggggcatacaaggttgcagttgaaaacagaaagagaccctcaattcttgccctttcacgtcaaaagcttgcaaaccttccaggaacctccattgaaggagtcgccaagggaggttacacaatatcagacaactctacaggtaacaaaccasatgtcatcgtgtgtgctactg

SEQ ID NO: 182 - DNA, 739 bp, Artificial Sequence
  Synthetic
cccacgcgtccggaagaagaagaagtaatggcttcctctatgctctcctctgccgctgtggttacctccccggctcaagccaccatggtcgctccattcactggtttgaagtcatccgcttctttcccggtcacccgcaaggccaacaacgacattacttccatcacaagcaatgggggaagagttagctgcatgaaggtgtggccaccaatcggaaagaagaagtttgagactctatcttacctccctgaccttactgacgtcgaattggctaaggaagttgactaccttctccgcaacaagtggattccttgtgttgaattcgagttggagcacggatttgtgtaccgtgagcacggaaacactcccggatactacgatggacggtactggacaatgtggaagcttccattgttcggatgcaccgactctgctcaagtattgaaggaagttgaagaatgcaagaaggagtacccgggcgccttcattaggatcatcggattcgacaacacccgtcaagtccagtgcatcagtttcattgcctacaagcccccaagcttcactgatgcttaaatccttttctggaatattcaatgttgactatccggaacccaattttgtatggtcaatgtaaatttaagtaattattttgccaaagtgaaaaaactgaaggtttgtttttctatcatttcctctataaaaatctctattcatatcacttcatttctgctaaaaaaaa

SEQ ID NO: 183 - DNA, 617 bp, Artificial Sequence
  Synthetic
cccacgcgtccgcaaacatcagaagccctagagcttgagccggsgaaaatgtcgaagcgaggacgtggaggaacgtctggtaacaaattcaggatgtcacttggtctgcccgttgcagccacagtgaactgtgcagacaacactggtgctaagaacctttacatcatctctgttaaaggaatcaaaggtcgtctcaatcggttaccttctgcttgtgttggtgacatggttatggccactgtcaagaaaggtaaaccagacctcaggaaaaaggttcttcctgctgtgattgttaggcaacgtaagccatggcgccgaaaggacggtgttttcatgtactttgaagataatgctggagtgattgtgaaccctaagggagaaatgaaaggttctgcaattactggacctattgggaaagagtgtgcggatctctggccaaggattgctagtgctgctaacgccattgtctgaagatcatttatcacttttgctggttatgtatctgtcttcaacgaaacgcgaaatagttggtgttttgagtgttttaagtagagacgacaatcttttgtgagcttcagacatatttccagtttctaagagattttgcttagattaaa

SEQ ID NO: 184 - DNA, 750 bp, Artificial Sequence
  Synthetic
cccacgcgtccgcttcttcagggttcaggtgtgaaagctgacgccaccgtggcagctgacggtagcggtacatttaaaactgtggctgctgcggttgccgcggcccctgaaaatagtaataagaggtatgtgatacatataaaagccggagtttacagagagaatgtggaggttgctaagaagaaaaagaatataatgtttatgggagatggtcggacgagaactattatcaccggaagtcgaaacgttgtagacggtagcaccactttccactccgccaccgttgctgctgtcggcgagagattcttagctcgtgacatcactttccaaaacacggcgggtccgtcgaagcaccaagcggtggctctccgtgtgggttctgatttctccgccttctacaattgcgacatgttagcttatcaagacactctatacgtccactctaaccgtcaattcttcgtcaaatgtctcatcgccggaaccgttgacttcatcttcggaaacgccgccgtcgtgctccaagactgtgacatccacgctcgccgccctaattccggtcagaaaaacatggtcacagctcagggaagaacggatcctaaccagaacacagggatcgttatccagaaatgtaggatcggtgccacgtcggatttacagtcggtgaaaggtagttttccgacgtacttgggtcggccatggaaggaatattcacaaacggtgataatgcagtcggctatctccgacgtgatc

SEQ ID NO: 185 - DNA, 744 bp, Artificial Sequence
  Synthetic
cccacgcgtccggaagaagttccgtataacatctccattattcagatcagtagagttttaccgtcggagactgcggcggctccgactcctgctccggcggagatgaatcttaccggaataatgtcggctcatggatgcaaagtgtttgctgagactcttctcactaaccctggagcttcaaaaacctatcaggagagtttagaaggaggcatgacagtgttctgtccaggagatgatgcaatgaaaggtttcttgcccaaatacaagaacttgacagctccaaagaaagaagcatttctcgatttcctcgctgtcccgacatattactcaatggcgatgccaaatccaacaatggtccgatgaacacacttgcgacagatggagctaacaagtttgagcttactgtacagaacgatggagagaaggttaccctcaagacaaggatcaacactgtcaagatcgttgatactcttattgatgagcagcctttagctatatatgcgactgataaggttttgttgcctaaagagttgtttaaggcttcggctgttgaagctccggctcctgctccggcaccagaggatggtgatgttgcggattctccaaaagcggctaaagggaaagcgaaaggaaagaagaagaaggctgcaccgtcgccagataatgatccttttggtgactcggattcgcctgccgaagggcctgacggagaggccgatgatgcgacggcagatgatgctggtg

SEQ ID NO: 186 - DNA, 717 bp, Artificial Sequence
  Synthetic
atcatcatcatcatcatcgcgtaaagaccaaaacgccgattgcgaattacttgttaaaaacgacgcctttgggattacggcgagaggagagcttttcagtgacgtcatgtcggttggctctgttacttctccgggaaccgttgatctacttttcgcttgtactccaccgtggctgttacgtgggctcgctagtggagcccaaggagtaatgggcttaggaagggcccaaatctcactcccttcacaactcgccgcggaaactaacgaacgtcgtcggttaactgtttacctgtcgccgttgaacggtgtcgtatcaacgagttcggtggaggaggtttttggagtggctgcgtctagatcgctggtttacacgcctttgttaaccggttcgagtggcaactacgtaattaacgtgaaatcgattagagtcaacggggaaaagctctccgtggaaggtccgttggcggtggagctgagcacggtggttccttacacgattttagagagctcgatctacaaggtgttcgcggaagcttacgccaaagctgcgggtgaagctacatcggtgcctcctgtcgcaccgtttgggctctgcttcactagtgacgtagattttccgcgcggtagatctagcgttgcagagtgagatggtgcggtggaggattcatgggaagaatctgatggtggatgttggtggtggagtccgatgctcgggga

SEQ ID NO: 187 - DNA, 599 bp, Artificial Sequence
  Synthetic
aattagtcttaattgatacaaaaacatcattaaaaaagcaagtgcaaaaattctgagtagagaatgataataaaatggaaaaaactcaataaccacccttgagatcgttgacaacatcgtaaggaatgggagtgacagtctccaatgtcataccttcraccatgaaacccggtttaggacctttaggctgtctcttggtgctgatagtctcwcctctggctttagcatcagccttaagcacatcgttctgyttctttctgagtttaaactcctcagcacaccttgactgttgcacatgctccacacgcacatgtatcctcttccttatgattctgttcccaatctgtttgttgacttcaacaccaacggcacgyttagtgacattccagatgcgaccagtacgaccatggtagaacttatgaggcatacccttgtggatagctccattaaccttgacatcgacgtaatcgccgaccttgaaggttctgaggtaagtggagagtggaatataacccttcttcctgaatggtctcgcgaacagatctcttrttctcgccctcactccgtgtcccgccggcatttttcmkcggacgcgtggg

SEQ ID NO: 188 - DNA, 662 bp, Artificial Sequence
  Synthetic
cggacgcgtgggtcgcccacgcgtccgcccacgcgtccgcccacgcgtccgagaggatctcagaatatggagagaaatgagtgcacttgttgaacgcatgtgctggaaaatagcagaaaaaaggaaccaaacagtgatttgggtcaagcctctaaacaatgactgttacatggaaagaccagctggtactcaaccaccactttgtcggtctgatgatgatcctgatgctgtttggggtgtgaatatggaagcatgcataacaccttattctgaacatgaccacaaagttagcgggagtggactggctccttggccagctaggctaacttctcctcctcctcgtcttrctgattttgggtatwcaactgaaatgtttgagaaggacatggagctttggcaacgaagggttgaacattactggaatcttttaagtccaaagatctcytcagacagtctgakaaayatcatggatatgaaggccaatttggggtcatttgctgctgctttgaaggacaaagatgtttgggtcatgaatgttgtatccaaagatggacctaacactctcaagattgtatatgaccgtggtttgatcggcacaactcatgactggtgtgaagcattttcgacatatcctaggacctatgatttggtccatgcgtgga

SEQ ID NO: 189 - DNA, 409 bp, Artificial Sequence
  Synthetic
cccacgcgtccgatagacatgtttcttcgcggtcaccacatagsgagcattctcagcacaagaacactctctactcttctcatgacaaatccaggtcgaagcggtcaaggtccagatcaagatccccccacaggcgccatcgtaaatgaacactctagcaaactggtctgagactgtacccgggacaatattgtgcgcggtggatcacaggattgggttaatgtactggacggacatcgatataatcaaaaactataaagtcaccggtttgtgagcgaaatagtgcatagtaaaccgctctttccttagttcttcagaagaaatatccaaagatttttgactgacttgtttgacaatatcgttggttggttaagcgttcctatgtaaaattttgttccctctgaaaaaa

SEQ ID NO: 190 - DNA, 799 bp, Artificial Sequence
  Synthetic
cccacgcgtccggaagaatccgaatccaattcaatgagtcttcttcgtcttctcctcgttgttgttgttcttcatctttctgcggtggccggcgacgacgccatcgtctccagattccaggagtacctccgaatcaacacggttcagcccaacccggaatactacaaagccgttgactttataatatctcaggcgaaaccactgtccctcgaatctcagacgatcgaatttgtaaaaggaaagccgcttctcctcctcaaatgggttggctccgacccaaccctacctgcctttctcctcaactcccacaccgatgtcgttcccttcgaggactccaagtggactcaccatccgctccaagctcacatggaccaccatggcgacatctatgccaggggttcccaggacatgaagtgcgtcgggatgcagtacctcgaggccatacgcaagctccaggcttctggcttcaagccactccgatccgtctatctctccttcgtccccgatgaagagattggcggccacgatggcgcagagaagtttgctgaatcccaattattcaagagcttgaacatcgcaatcgtgctcgacgaaggcctgccatcgcctactgagagttacagagtattctatggagagaggagtccctggtggctggtgattaaggctaaaggtccacctggccacggtgccaagctctatgacaactctgccatggagaatctgctcaaaagcattgagagtattcgcagattcagagcttctcagttcgatcttctcaaagctggtgggatagctg

SEQ ID NO: 191 - DNA, 467 bp, Artificial Sequence
  Synthetic
cccacgcgtccggaaggtgataaggagcatttgatgtctgaaatgaactttgagaaaacatttgggcaatcatccatctttgtaacctcaactttgatggaagaaggtggtgttcctccgtcatcaagtcctgcagcaacagctgctttgacggcggtgatgagcaatcccgcgatggctttggttgatgagaggatgtcaacagaaggaacaggattaccctttggtctaagcaacaacctcttgggttggattctgtttggagtctttggtttgatctggactttcttcttcgtctacacttcatctctcgaggaggatgaagaatctggtctttcactctgaaggaagaatcaatctttcgtcttctcatttccattttcatgtgagaacatgaatcaaaagtgttcacccttctagtttcttgtaattgttaagtaaagactaaaaactattttcaaaaaaaa

SEQ ID NO: 192 - DNA, 590 bp, Artificial Sequence
  Synthetic
cccacgcgtccggattcgataagaagaatctacatggctcgacatatcatggagaagttcatcgtcgcaggagcggaaatggaattgaacttatctcataaaacccgacaagagatcttaaccactcaagatctaactcacactgatctcttcaagaacgcattaaacgaagtcatgcaattgatcaagatgaacttggtaagagattactggtcatccatctacttcatcaagttcaaagaagaagaaagctgccacgaggcaatgcataaggaaggatacagtttttcatctccaagactgagttcagttcaaggctctgatgatcctttctatcaagaacatatgtcaaagagttccagatgcagtagtcccggttaaggagtctaaaactggtactagaccagaacccaaaccaatgttcatagcaatccaatccatgtaatcttccttcacatttcttgtacatgtcattttctctcttgttatacctaactgtaagagaaaatgtccggttcggattttggtttagttttaaatgtgtataccggacaaaaactatggaaccatactaattaatatctcgaaga

SEQ ID NO: 193 - DNA, 743 bp, Artificial Sequence
  Synthetic
cccacgcgtccgcaaagctgaacttggacgatgtgttcgggcagaagaatgaaattgccaaatctgtggaagaagagctagacaaagccatgactgcttatggttacgaaatccttcaaaccctaattatcgacattgagcctgatcaacaggttaaacgtgccatgaacgaaatcaacgccgcggcgaggatgagagtggcagcgagcgaaaaagcagaggctgagaaaatcattcagatcaaaagagcagagggtgaagcagagtcaaagtacctgtcgggactcggaatcgctcggcagagacaagcgatcgtggacggtctgagagacagtgttctagggttcgcaggaaacgtgccagggacgtcagcgaaggatgtgttggacatggtgatgatgactcagtactttgacacaatgagagatatcggagcaacttctaaagcctcggcggtgtttatccctcacggtccaggcgccgtcgctgacgtggcaacgcagattcgaaatggattattacaggccaacaatgcctcctaatcactcaagtcaaattgtcttggtcttctctttatatatttttgtatcttcttattaaaaaggtaaatttgacttttaatgtaatggtgtgctgattgtgatttgtcattatgtttgtacctatctcttttgtgagttgtgtgatagatatactttgtatttgttcttaaaagtcaatataaatttctgtttgcgagagaa

SEQ ID NO: 194 - DNA, 691 bp, Artificial Sequence
  Synthetic
cccacgcgtccggaaacggtgaatctggttttgggttgggaacaggtggttatgcagcaagaaacccaggggctaacaaggcagcaccatcctcttcattctcttctgcctcagcaaccaacaacacgggttatgatacagcaggacttgcagagttttacgggaatggtgcagtttatagtgaccctacatggagatcaccaactcctgagacagaagggcctgctccttttagctatgggattggaggaggggttccttcttcagatgtttcagctagaagttcatctccaggttatgttggcagttacagtgtgaacaagagacaaccaaacagaggaattgctacttagtacaatcgtttttgttttaccacgatattgtaggcgagccatcacggtgaacgatctgtgtcttttggcgaatcttttagattatcttcttttcccttcatacaaagccagtgaggacgaaacttgatcatatcatcacctagagctaaccagagaatcccgcagacttttctgtcatggtttggttttctaaattcattgttcctcctaggctttttttctgctttctttttttttctatttttgttttcttttcttctttcaatgagggacagaagaaactgtatcagtctccggcgaggcggtaatacataaggagagttcaaaacaaaaaccca

SEQ ID NO: 195 - DNA, 636 bp, Artificial Sequence
  Synthetic
ccccccccgatcgcttctcatcgcaaatcgcatcgacttcgattcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcatcctctgctcctacgacccc

SEQ ID NO: 196 - DNA, 341 bp, Artificial Sequence
  Synthetic
cccacgcgtccgacgatgttgatcacaaggggcaagagatggtaacaacagtttgcatgaaatgccacatgctggttatgttgtgtacatcaactcctgtttgtcccaactgcaagttcatgcacccacacgatcacagctctacaaaactgtttaaaccatcaaatttgcttaggcttctatgctaggctctttcaaggttactgaatctataaaatttgtacggcagataataagccaagagactagatatggacaaagttatgtatatactaaaagtaccagaaagtttgtattaattctctgcttctatgaacgatcatgctttagatctctaaaaa

SEQ ID NO: 197 - DNA, 581 bp, Artificial Sequence; identical to SEQ ID NO: 166
  Synthetic

SEQ ID NO: 198 - DNA, 713 bp, Artificial Sequence
  Synthetic
cccacgcgtccggatatgagtagccaaatcgctttgtcaccggccatcgccgccgccattcgccgtccgtcctctcacgactgtctatccgcttccgccactactgctaccgccacccccatggctctcaaatcttgcatcgtcgcacctctctcgctattcacctctcaatctcaaatcaaacactcaagctcaagaaaaacttctcgaaccacgattcgatgcgatgtagcgataaaatccgcagattcgataaacgcagacgccaatccttcgtcctcaccgtcatcagaggaagaaatcgaagcggaagcgaaggcgaagataggatctagggttagagtaactgcaccgttgaaggtttatcatgtaaatcgagttccagaggttgatttagaaggtatggaaggtaaactcaaagattacgttgctgtttggaaagggaaacgaatctcagctaatcttccttataagattgagttcttcaaagaaattgaaggtcgtggtcttgttaaatttgtttcacatcttaaggaagatgagttcgagttcattgatcagtgatgaaacaagaaagacaatttttgttttcctttctcagtgtttgtttttgtttgttgtgtttactggaacctgggaatggagaatgatttgtatgtagtgtgatgtgtattcaacctttagcaatcatatacataagggtttcttcaaaa

SEQ ID NO: 199 - DNA, 675 bp, Artificial Sequence
  Synthetic
tacaaagtttacactgttgatgcatacggatctttccyyatcgayrwcykctctacatttatcaagcaagtgtatgcggktggagcaaggaagatcggtgtgacatctctgcctccaacaggatgtcttcccgctgcaagaacccttttcggtttccatgaaaaaggctgtgtttcaagactcaacacagatgctcaaaactttaacaagaagcttaacgctgctgcttcaaagcttcagaagcaatattccgatcttaagattgttgtcttcgacatctactctccactttatgatcttgttcagaacccttccaaatccggattcacggaagcaaccaaaggatgttgtggaacaggaacagtcgagacaacttcactcttgtgcaacccgaaatcgtttgggacatgctccaatgctactcagtatgtgttctgggacagtgtgcatccttctgaagctgccaatgagattcttgccactgccctaattggacagggcttttctctcctcggttgatctcacgtatttttcttatattctcttttcaaatcgctgtttctatcacacattgagtcatacatttgtttttctttgaattatgtatcaaagcatcactgttttactaaaaatgtattgaaacttattacaagtactaamccaagagttgagaac

SEQ ID NO: 200 - DNA, 693 bp, Artificial Sequence
  Synthetic
catacattttatcagacaattcttctggcagggaaacctgatgtcattttgattggtactggctcagagttagaaattgctgtcaaggctgctgatgaactcaggaaagaaggaaagacagtgagagttgtttcctttgtttgttgggagcttttcgaagaacaatcagccgactacaaggaaagtgtccttccatcatctgttacagctagagttagcattgaagctggatccacatttgggtgggagaaatatgtcggatcaaaggggaaggccatcggaattgatagatggggtgccagtgcccctgctggaaaaatataccaggagtacggaattacagcagaggctgttgtagctgcagctaaacaagtttcttaggctttattacttacacttggttgctggtgtctaccaaatttgttttcagtttgacactgaggttggaggtgatggtggaaaccaataccaaacggactcggcagttcactgttgcctggtattttcaataaaaactatttcttcatctgccctttgttttcttcagttttagtagcggagcggccaaaatgaatccaagatgaggatagaaataggattatggatgctcctgaccatgtacactttaaaccatatctttgagttttgtaatttcatttggtcgagtgataccaagatcttattttcaattgg

SEQ ID NO: 201 - DNA, 516 bp, Artificial Sequence
  Synthetic
cccacgcgtccggctagtgggagaatccggttgcatcccggagatcgtgaaacttctggaatcgaagtcaaacggatgtcgagaagcggcggctcaggcgatcgctggattggtagcggaaggaaggattcgacgggaactgaagaaagacgggaagagcgttctgacgaatttggtgatgttattggattcaaaccctggaaacacggcgaagaagtacgccgtggcggggctgttggggatgtcgggaagcgagaagagtaagaaaatgatggtgtcgtacggagcaatagggtatctgaagaagctgtcggagatggaagtaatgggcgccgataagcttctcgagaagcttgaaagaggaaagctaagaagcttctttcaccggtaaaacgaacgatgcggagacattgaagcagccaagataaaaagtgtaatattgtctgatgtaagtttattaaccgttagttaaactttactagtaattaaaaagtgttctttgggctgaaaaaaaaa

SEQ ID NO: 202 - DNA, 726 bp, Artificial Sequence
  Synthetic
cccacgcgtccgcaaaagaagaagagaaacaacaagaagtagtaatggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttacctccctgaccttagtgacgtcgaattggctaaggaagttgactaccttctccgcaacaagtggattccttgtgttgaattcgagttagagcacggatttgtgtaccgtgagcacggaaacactcccggatactacgatggacggtactggacaatgtggaagcttccattgttcggatgcaccgactccgctcaagtgttgaaggaagttgaagaatgcaagaaggagtacccgggcgccttcattaggatcatcggattcgacaacacccgtcaagtccaatgcatcagtttcattgcctacaagcccccaagcttcaccgaagcttaatttcttttctaaaacattcttatgaattatctctgctcatttcatttcctattgtctgtgttctttttctctttatgagacaatttctatcggattgtcaaatgtctgatttatgaatatgtaatttatataaaaa

SEQ ID NO: 203 - DNA, 1626 bp, Artificial Sequence; identical to SEQ ID NO: 170
  Synthetic

SEQ ID NO: 204 - DNA, 597 bp, Artificial Sequence
  Synthetic
cccacgcgtccggagagaagaatagtttgatcatcttgggagaaaaataatggctgcttcagtgatgctatcttcggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaagggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacaagtgctttggctcagtaaatcttaaagttgttagcgcatgtgtaatcatgtttctataaatgtttctgtgttgttctctttctctctaatgttgtaaaactcagacatactttgaatttataagacttctagtgtttgtataa

SEQ ID NO: 205 - DNA, 649 bp, Artificial Sequence; identical to SEQ ID NO: 171
  Synthetic

SEQ ID NO: 206 - DNA, 478 bp, Artificial Sequence
  Synthetic
tcgcgcgtcttggttgtaaacaccgacccttctatcgtgtagttgtcgccgatgaaaaatcgcgcagggacggtaaacaaatcgaggtgttaggcttttatgatccactccaaggcaaagaagatgcggatagagtgagcctcaaattcgacagaatcaagtactggttatctgttggagctcaaccaacagacacagtggaaagcatgcttttcagggccggtttgataccaccaaagcctatggtagtggtcggttcgaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgtt

SEQ ID NO: 207 - DNA, 611 bp, Artificial Sequence
  Synthetic
cccacgcgtccgctcggtgaggctgtcggtgttgaagggctggttgtcggtctgcgcgctcagcgccagcagcgcgcgccgcgagaagcaggtaccgacaccggccgacggcaccatgccggaaacactttcgcgcaccaccagatccttggcatgccattcggcgaactcgtccatgtagacgccggccaccagttcgtaccactcgcggtccagcgaggtgaccggcaactggatcatgtccttgcgcggcaaaaggtagttgtagaagcgcagttccatcgggtgcagcacgtcctcgctgtcgtgcaggatcaccccggcgaactcgatgtcgtggcgcttctcgtaatcgaagatggccaggatcagccagttcaggcagtcggccttgctggtcggcccgtcatgcggcacttccacgcggcgcaggcgcttgtagcggcggcgcatgcgctccacttcgtcgatggtctgctggtcgttgggataggtgccgacgaacacgacgtactcgcggtaatcgagtacgttgatcatgttctccaccatctgcgcgatgacgtcgtactccatccacgccggcaccatgatcgccagcggctgttgcg

SEQ ID NO: 208 - DNA, 550 bp, Artificial Sequence
  Synthetic
gcagcagcaagagcctcaatacgtccatggtaagggtaaccaccacggtcaaaggctacctttgtgatacctttctccaagcaagattttgctatcacttccccaactttcttcgctacctcaatggttggtccagaggtgtagtcgaactcttcagagattggtttctgcttagtggaagctgaagctaaggtgtgcatcttggtatcatcaatcacttgaacataaagatgcttgtttgatcggaaaacacatagccttggcctctccgttgtaccattaaccttcttacggatacgagagtggcgggcgattctgtcttcgctgctggttttggttttggcttcgacaaccatggaccgagactgaagcgaagaagacgaccatggtttaaggaaaacggcacggtgttgaagtccgtttcccaagaacgcactgcggttagttatcagactcactgaaccacacccactcacgctcgtcaytctctcttactcactctctctggctcgctctctgttcgtaaaagcctagttctagatcgcgagcg

SEQ ID NO: 209 - DNA, 934 bp, Artificial Sequence
  Synthetic
ctcaatggagtacaaacatttcagccatccacacactctaaaactccaacagattcagccacataaaagctcagattcttcagtaatctgctcaggttgtgaatcagccatctctgaatccgaaaccgcgtatatctgttcaacatgtgacttcaatcttcatgagcaatgtggtaacgcagtgcgtgggatgcaacatccttctcacgctggtctccaccacttgactctagtcccttacacaacttacagcgctggtaccttcctctgcagagcctgtggctgcactggaggtaaagggttctcttactgttgtcckttgtgtgactttgaccttcatgttcaatgcgctcacctgcctcaggtcttggttcatgagtctcatcctatgcatagtcttcttcttgtctacaacagtactcctcctatgtcttttactcagtttggtttcgggaatcagcttgtttgcaatctttgtaatatgactatggatggtaggttttggtcttacaactgttatgcttgtaactatcatattcatgcttcatgtgctgtgaataagcccaatccagtggctgcttctgctgagaactgtggggcgagtgatgaaggaaagacaccgactgctgaatctgttcctgttcagggtttggagactgagcagacggaacaagtagctgcaataacagagcaagtggaagatccagttttgaggcaacagcttgagcttcagaagcttcagcttgagctagatatgagttctgctctcgcaaacatgattggttccttcaatctcagttctttcgtttgaagtgtctttgtgtttcagtttgtttgattttatgcatttacatgtgttgaattgtctctgttcttgtgttccctaatgtccctctgatttgaataaatatatcctatctatttggtttaaaaa

SEQ ID NO: 210 - DNA, 433 bp, Artificial Sequence
  Synthetic
gcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatatttagatacaacaaataagtttg

SEQ ID NO: 211 - DNA, 616 bp, Artificial Sequence
  Synthetic
cccacgcgtccgtgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggaatatacaaatcaatccaagtggtcttggtacgggagagggaaaagctttgtcgatgtatcttggccttaatgtgaatgagatattcagaccatatgagaagatttatgttcgagccaagcttcgagctcttaaccaactcaatctcagtaacatcgaaagggaactcgatatttggtacaatggtccgggatatggagaatatagctggggtttccctgagtttatctatttcccttatctcacagattcatcaaagggtttcgttaagaacgatgtgttgatggttcaagttgaaatggaggccatttyttcaaccaagtacttcccgagttagattttctytaagcaaagaacttgtacctacctccatgtgtttgatttgttatcaaatactaataagaatttgattatgcmtttcaaatacaattgtttctttttcttaaaaaaa

SEQ ID NO: 212 - DNA, 630 bp, Artificial Sequence
  Synthetic
cccacgcgtccgctttcatgtgagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcacaactgactaaagacggtgaaacgtgtgagatcccggtttgaaggttaatgaaacaggctttgcttactctcttctgtcagtctcttttagctccttgtaatcctctgtgtctctgtctgtttctccatattacctgtaatcaaagctatctgctaaacctacgacatggttaaataaatgcattgagacttagtaaaaa

SEQ ID NO: 213 - DNA, 669 bp, Artificial Sequence
  Synthetic
gctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgatatctgcagc

SEQ ID NO: 214 - DNA, 477 bp, Artificial Sequence
  Synthetic
tttttttagwtwttaaagagtacaacaatgttgattaacttagttcctctgtacattgaagattccaaatttgttcatggagctacaacggttcaacaataattcaagctcaaaaaccaagaactctaagatgaaacacactcacagacagacatgaaagtgatggaagatagataggtatgagatcataagtctgtcttcactctttagttgaaggtttggacaatagtgttgtgccatgggtcagacaagtgctgcaacagattctcaaatggtccttttccagtcacattgtgttgaaccacaaaccctaagaatgccaacatcgccaacctcccgtttgctagctctttctccttggcctcttgcgtaggagcaaagttaagcgggttaaagattccaccagggtaaccaacttcacccttaggtaagctgtattgcttaaagatagggtcttggttcacacttcctgggttc

SEQ ID NO: 215 - DNA, 613 bp, Artificial Sequence
  Synthetic
cccacgcgtccgaaaacaatcgagaaccactctttcgtgtcgcaataacaatmmsamrsrwmsraaaagaaaaccagagatggcgatgacgacagcatctacggtatttgttctaccggccaatgtcacctcggtcgccggcgcttcgtcgtccaggagctccgtgtctttcttgccgatgagaaacgccggttctaggctcgtagtcagggcagccgaagatcctgctccggcttcctcttcttcaaaagattctccggcagctgccgctgctccggatggagctactgccaccaaacccaagccaccaccgattggtcctaagagagggtctaaggtcaagattctaaggagagaatcctattggttcaagaacgttggatcagttgttgccgttgatcaggaccctaagactcgatacccggttgtggtccggttcgcaaaagtcaattacgccaacatatcgaccaacaactatgcattggatgaggtcgaagaagttgcagcttaaatgggagaattcaaaaactctgtgtattytataccggtttatccgtttgtaacttgacccaaaccgtatgtaccgcaaaagttymccaattatttctcctcc

SEQ ID NO: 216 - DNA, 881 bp, Artificial Sequence
  Synthetic
cccacgcgtccgtcatcttcttcttcactcgcctcaatttttgttcccttcttcttctataattcaactgtgaatttcaccgacgaaacaaaaaagagagagagagagagagaaacgatgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatagcgtaaaaggctaaaactccacccactagatatcggatcgtatcttataaaccatataatatacgaatacgattaataatatatcaaaaagattggaaataggtgtgctttttgaaattagtgagcgttttttatggaaaagaaaagaaaagaaag

SEQ ID NO: 217 - DNA, 561 bp, Artificial Sequence
  Synthetic
cccggctactgcgcctccactcccacccgtagcgcctccccgggaacccactcccagccgccgccgccgccacctgcaaccgagggctcgccatgccgccgaagctcgacccgacgcaggtggtggatgtgttcgtccgcgtgaccggaggcgaggtgggcgcggcgtcgtcccttgcccccaagatcggccctctcggtctctcccccaagaagatcggtgaggacatcgccaaggagacggccaaggactggaagggcctccgcgtcaccgtcaagctcaccgtccagaaccgtcaggcgaaggtgtccgtcgtcccctccgccgcggcgctcgtcatcaaggccctcaaggagcccgagcgggacaggaagaaggtcaagaacatcaagcacagtggtaacatcagcctcgacgacgtcatcgagatcgccaggatcatgaggaacaggtccatggccaaggagatggccgggaccgtcaaggagatccttgggacctgcgtcagcgttgggtgcaccggcgacggcaaggaccccaaggatctggagcaggagatct

SEQ ID NO: 218 - DNA, 462 bp, Artificial Sequence
  Synthetic
caagaagaaatttattgcacgatcaaaatcataccatggatcaacactaatatcagctagtctatccggtcttcctgcactgcatcagaagtttgatctgcctgcaccttttgttctgcacacggactgccctcactactggcgcttccatcttcctggtgaaacataagaagaatttgcaactagacttgccaataatttagaggaacttatcctcaaagaaggaccagaaacaattgctgcattcattgcagagcctgtgatgggtgctggtggtgtcatacctcctccaaagacctattttgaaaaggtccaagcgatcgttaagaagtatgacatccttttcatagcagatgaggtcattactgcatttggaaggttgggaaccatgtttggaagtgatatgtataacatcaagccagatctagtctccatggccaaggcgctttcatctgcctatgt

SEQ ID NO: 219 - DNA, 443 bp, Artificial Sequence
  Synthetic
ggcgctcaagttctcgaacgcgtgcggagccatctgcaccaccaagaagggtgccatcccggcgctgcccaccgtcgccgtcgcgcaggagctcatcagcaaggcagccaactagagctcctcggtttcgtcgtcgatcgccgccattgggggcctcggaattttaggtcgatttaatttagttgctgcttcgttttagacaaggaagaggaggggcttgggtgtgttcatgtctgtcttttgtgtgctaagttagttgcttccgtgtgagaacttttggcgtttatttttactattattattaataagaagctcttggatttgcggtggatattttggtctgaatttgtgtaatgaggcagctacttggcgaaatttattgtgtcatgtctttgttcagaggaaaagaaaatcttttcgtgtgctctgtttcaaatcagtta

SEQ ID NO: 220 - DNA, 466 bp, Artificial Sequence
  Synthetic
cccacgcgtccgatttgctgctgccattgagtccccaaaatcttgggtgatgaatgtcgtgcctacgatttcaaagatgtcaactctaggggctatttacgagcgaggattgattggcatataccacgactggtgcgaagctttctctacttacccaagaacgtatgatcttatccacgctagtggccttttcaccctgtacaaaaacaagtgcaacatggaagacatcctactggagatggaccgcgtcctgaggccagaaggcgccgtcataatgagggacgatgtcgatatcctgacgaaggtgaacaggctcgccctcggcatgaaatggaacacgaggctggtcgatcacgaggacggcccaatggtgcgtgagaaggtgctgtatgctgtgaagcagtactgggtaggcggaaaccagactgcagcagctgcagcatgaagcaggcgtaaatcctaacac

SEQ ID NO: 221 - DNA, 426 bp, Artificial Sequence
  Synthetic
ccgaaccctagcctgcttctcctcctcctccccgccgccgccgccgcgagcacagacgacgcagccatgtccgggaggaagaagacgcgagagcccaaggaggagaacgtgacgctcggccccacggtccgcgagggcgagtacgtcttcggcgtcgcgcacatcttcgcgtcgttcaacgacaccttcatccacgtgacggatctgtccggcagggagacgctcgtccgcatcaccggtggcatgaaggtgaaagctgaccgtgatgagtcatccccttatgctgccatgcttgcatcccaggatgttgcacagagatgcaaggagcttggaattactgctctgcacattaagctccgtgctactggtggaaacaagacaaaaactcctggtcctggtgctcaatctgcgcttagagctcttgca

SEQ ID NO: 222 - DNA, 482 bp, Artificial Sequence
  Synthetic
aacaaagcattgcgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttagatccaaggctagcttgctatgccgatccgggcggaagacattgtcaggtggggagtttggctggg

SEQ ID NO: 223 - DNA, 478 bp, Artificial Sequence
  Synthetic
gaattcaggatagcattcattctggaacaggttcgtctgtgtttggaccgtcaagattatgtgcgagctcagatcctgtcaaggaagattagtccacgagtttttgacattgatgcttcaaaagaaaagaaaaagcctaaggagggtgataatgttgttgaagaggctcctgctgatataccttctctcttagagttgaagcggatctattatgaactaatgataaggtactactcccacaacgatgattaccttgaaaaatgccgttgctacaaatcaatatatgatattccatctgttaaagaagatccggctcaaatggttcaggttttaagaaagatctgctggttcataatcttggcgaaacacgatccaatgcagtcaagcctccttaactccactttggaagataagaatctctctgagatccagaattttcgggtactactgaagcagatcgccacaatggaggtcatcc

SEQ ID NO: 224 - DNA, 475 bp, Artificial Sequence
  Synthetic
gaattcaggtgaacgaaatggcaaatactctatccatggctggagttaaccattcaatcatttacaaaaccacagccatctcttcttcttcttcatctcaagcttcatcccttggatggacaaacaagtttcaattcaccaaaaatcaatggatgggtacatcaaaattctcatctttaagaagaactagtaccaccagcaccacattagttcatgctggttcttctaaggcagatgattctgccccttctgggatgtctcttgaagacgctttaaaacttttgggtgtatctgaaggtgcttcatttgatgaaatacttcgtgctaagaattcaattctatccacctgtaaagatgaccaagacgctatcgcccaggtagaggctgcatatgatatgttgcttatgcagagcctaacgcagcgtcgagctgggaaagttttaagtaatagcattcgttatgctgatgcaaagcc

SEQ ID NO: 225 - DNA, 471 bp, Artificial Sequence
  Synthetic
gaattctcgcagatctctatataggtgatttttgttatgttaaataccaactttttttgaactgtgatagaaaggtactaatcttattttaaatatgaggtttatttattggaatgtgcaaggttatggtaacaaggacactagaaaacacttaaacaatttagttcataccaatgatcctaatgtgattttcttatctgaaactaaaattagtttcaagaaaatgtctagattcatccagccgttaaaatatcataactttttcattgttaatcctataggactgtctggtggtctctgtcttctttggaaacatggaatgaatttggaaatcatcagttcccaattcaatgtcataaattgtgtatttcaatttgatggcaggtctaagattgccttttcttgcatgtatggtgctttttgtaatggtaatagggatgcccaatgggattttattagacaatttagaca

SEQ ID NO: 226 - DNA, 467 bp, Artificial Sequence
  Synthetic
cccccctgctcaggctcaggggagggatgcagatcttcgtcaagaccctgaccggcaagaccatcaccctcgaggtcgagtcctcggacacgatcgacaacgtgaaggccaagatccaggacaaggagggcatccccccggaccagcagcgtctcatctttgctggcaagcagctggaggatggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaatgtgaaggccaagatccaggacaaggagggtatccccccggaccagcagcgtctcatcttcgccggcaatcagctggaggatggccgcaccttggctgactacaacatccagaaggagtccacccttcacctggttctc

SEQ ID NO: 227 - DNA, 434 bp, Artificial Sequence
  Synthetic
cccccccccccgggagctagggttggatcgccgccgccgccgccgccgccgccgcttctccactctcccctgcccccgtcgccgtcgccaccgccgccgccatgtccgggaggaagaagacacgggagcccaaggaggagaacgtcaccctcggcccgaccgtgcgcgagggcgagtacgtcttcggcgtcgcccacatcttcgcctccttcaacgacaccttcatccatgtcaccgatctgtccgggagggagacgctcgtccgcatcactggtggcatgaaggttaaagctgatcgcgacgaatcttccccttatgctgctatgcttgcttcacaggatgttgctcaaagatgcaaggagcttggaataactgctttgcatatcaagctccgtgctactggtggtaacaagacaaaaacccctggtcctggt

SEQ ID NO: 228 - DNA, 477 bp, Artificial Sequence
  Synthetic
gaattcagagctcagacacaattgacaacgttggggctaagattcaagacaaggaaggaattcctccagaccaacaacgtttgatcttcgccggaaagcagttggaagatggaagaactttagctgactacaacatccagaaggaatcaactctccatcttgtccttcgtcttagaggtggtatgcaaatctttgtcaaaaccttgactggtaagaccatcactttggaagtcgagagctctgacaccattgataacgttaaggctaagattcaagataaggaaggaattcctccagaccagcaacgtttgatcttcgccggaaagcagttggaagatggtcgtactcttgccgactacaacatccagaaggagtctactctccatttggttcttcgtctcagaggtggtatgcagattttcgtcaagacccttactggaaagaccatcaccttggaggttgagagttccgacacca

SEQ ID NO: 229 - DNA, 471 bp, Artificial Sequence
  Synthetic
gaattcacgacatcaagttgaacaatgcaaggcttgcagaggaaaagcatgtgcctatgtacgatgaattggctgctaaagacaatgttgagtacattgctggaggtgcaactcaaaattctatcagagttgctcagtggatgctacaaactcctggtgccactagtttcattggttgcatcggaaaggataaatatggtgaagagatgacgaaaaactcaaagcttgctggtcttaacgttcactactacgaggatgagaccgcagctactggtacgtgcgctgtttgtgttgttggtggcgagaggtctctcattgccaacctggccgcagcaaattgctacaaatccgaacatttacagaaaccagaaaactgggctttggttgagaaggctaaatactattacattgctggatttttcctcactgtttcccccgactccattcagcttgtagcagagcatgccgcta

SEQ ID NO: 230 - DNA, 474 bp, Artificial Sequence
  Synthetic
cgacgaattcgtaaccctaagaacccttactggtttgacagagatagattcgttctttctgctggtcacggttgtatgttgcagtatgctttgcttcatcttgctggttacgacagtgttacgacagaagatttgaagactttccgtcagtggggaagcaaaattcctggtcaccccgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagatggatgtcaaatggagggaattgcaaatgaagcttgttcgctagctggacattggggacttggaaagctgattgctttctacgatgacaaccacatctctattgatggtgacacagagattgctttcacagagagt

SEQ ID NO: 231 - DNA, 470 bp, Artificial Sequence
  Synthetic
gaattcaaatcaaaaatcaatattatcaaccgttatccagtaaaagttggaatcctagcatcagaagtatcgtccattactagacttactcttgacaccttctcgacaagcttcagcagaaggccagagaggaaaccttacattaggatcataagaaaccaaaccatcaacaaaaacctcataagaaagcaaaccagccacaaaaaccaaaccagcaatggttggagaggcccgaggagagagagattaatttgtaatcaatttgtttgtttgctgatagcccatgtagggctattatgtgggcatccaaaccatcactggttggcgatatgtattgaaacctaatataatatatggaagatcattgaaatccctttttccattacgggactattcgtggtcagttcgcgaaagagaggatatcttattataatgctacgtcgatcagcaccgcccttacaagcacacca

SEQ ID NO: 232 - DNA, 468 bp, Artificial Sequence
  Synthetic
gaattcacattgaaatcttcattgatttcggcgattgcatcatcacgatctaatcgtgtcaatacaccatcgttatcgagatcgttggtggttcgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaatccctggtcaccccgagaacttcgagactcctggtgttgaagtcact

SEQ ID NO: 233 - DNA, 458 bp, Artificial Sequence
  Synthetic
caggggagaaagccctaatctcaaggccgcggctgtgagcgctcctcccgtctctcccccaacccgccgccagccaccgagctcgccaccgtctccgttgcctcgccgtgctctaggttctcggatggaggccgaggcggcggcgaacagggcgcgggagagcggtgacgcggcggcggccggtgccggcgagcaggcgggtatctctgccgtcatccctggatggttctccgagattagccccatgtggcctggtgaggcacactcattgaaggtcgaaaaggtactattccaaggaaagtcggactaccaaaatgtgatggtgtttcagtcctccacgtacggcaaggtgcttgtgctggatggagtgattcaggtcactgagagggatgagtgtgcttaccaagagatgattacccacctccccctttgctctatcaaagatcccaaaaaggtgt

SEQ ID NO: 234 - DNA, 466 bp, Artificial Sequence
  Synthetic
cgctcctccgtcctcctctctctcctcaaagggaacatcgagagagagagagaggtctaaaaccctaacccccgaatcgaatctcgtcggaagccgccgccgccgccgccgacgacgacgacgcccgcgacgccatggacatgggagcgatgagcgatccggagaggatgttcttcttcgacctggcatgccagaacgccaaggtcacctacgaacagaacccgcacgacgccgacaatctcacgcggtggggaggcgcgctgctcgagctctcgcagatgcggaacggccccgagagcctcaagtgcctagaagatgcggaatccaagctggaggaagcactgaaaattgatcccatgaaggcggatgcgctttggtgcttgggaaatgcacagacctctcatggattcttcacttcagacactgtcaaggccaatgaattctttgaaaaggcaacccagtgttt

SEQ ID NO: 235 - DNA, 459 bp, Artificial Sequence
  Synthetic
cggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccgg

SEQ ID NO: 236 - DNA, 469 bp, Artificial Sequence
  Synthetic
gaattcaagaacattgaaatcttcattgatttcatggattgcatcatcacgatctaatcgtgtcaatacaccatcgttatcgagatcgttggtggttcgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccccgagaacttcgagactcctggtgttgaagtc

SEQ ID NO: 237 - DNA, 336 bp, Artificial Sequence
  Synthetic
gaattcaagaataagaacagaggagaaggaaaaaggaaaatcaatcctttattccaaaaggccactccagaagagaggaatgttcgatttggtgtcaaagagcatgctatgggagccatctgtaacggaattgctctccacagtcctggttttgtcccctactgtgctaccttctttgttttcaccgattacatgagaggtgccatgagaatttcagctttatctgaagctggagtcatttacgtcatgacccacgactctattggtcttggagaggatggtccaactcatcagcccatcgaacatttggcaagctttagagccatgcctaacatt

SEQ ID NO: 238 - DNA, 472 bp, Artificial Sequence
  Synthetic
gaattcaagacagatacagcattagttgataaatcggtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccacgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgta

SEQ ID NO: 239 - DNA, 471 bp, Artificial Sequence
  Synthetic
gaattcatttagcaaagatgcttgtctaccaggggcttcttacaggtgatgagcttctctcggattcgtttccttatgaggaaatttgtgatggaatgttatggcaagttgaggggaagtgggtagttcaaggagctgttgctgttgacattggtgctaatccttctgctgaaggtgctgatgctgatgagggtgttgatgacgcagctgtgaaatgtgttgatattgtcgacacttttagactccaggaacaaccaccttttgacaagaaacagtttgttggatatatcaagaaacttatcaagactcttacacccaagctgggtgaagaggagaaagcaaaattcaacaaaggcattgaggcagcaaccaagtaccttcttccaaagcttaaggacttgcaattttttgtcggggagagcatggccgatgatgctacaattgtgtttgcatactacaaggaaggtgctg

SEQ ID NO: 240 - DNA, 483 bp, Artificial Sequence
  Synthetic
gaattcaagacagatacagcattagttgataaatgagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccacgagaacttcgagactcctggtgttgaagtcactacaggtccccttggacaaggtattgctaatgctgttggattggcacttgccgagaagcacttggctgcccgtttcaacaagcctgacagcgagattgtagaccattacacatactgtattcttggagat

SEQ ID NO: 241 - DNA, 472 bp, Artificial Sequence
  Synthetic
gaattcaagagccattggagccgccatactgctgaaggtgctgccctagaagctgaatggacagctaaatttgcagagtacgaaaagaagtactcagaggatgctgcagaatttaagtccatcattactggtgaattccctgctggttgggagaaggctcttcctacctacactccggagatcccagctgatgccaccagaaacctatcccagacatgccttaatgcacttgctccagtcctccctggtcttattggtggtagtgcagatctcgcttcctccaacatgaccttgatgaaaatgttcggagatttccaaaaggccactccagaagagaggaatgttcgatttggtgtcagagagcatgctatgggagccatctgtaacggaattgctctccacagtcctggttttgtcccctactgtgctaccttctttgttttcaccgattacatgagaggtgccatgagaa

SEQ ID NO: 242 - DNA, 469 bp, Artificial Sequence
  Synthetic
gaattcacattactgaaatctggtgatattttcgtttccttttgtttttacttttaaatagcttaaaaaatctgtgttatttgataacaggagattctctccattttaacttctgtttgatcatttctggtgctaaggtcaatttagtattatgaaaatcctagcttggaatctccaaggctgtggtactaaaaaaacaaaacaacactttgattttttgattaaatcggaaaaccctgatgtggtgtttttatcagaaacaaaaaagaaaagatctgttgtaagacaatttttgtcatattttccaaatgtgttcattgttgacccagtgggcatagcaggagggttagctatggcatgggtagacggttttaattttgatatagttcactctagtgtaaacatgattaacgtccttgttaaaaccaatttctctgataaagaatggttgttaacaggattttacggc

SEQ ID NO: 243 - DNA, 463 bp, Artificial Sequence
  Synthetic
ccgatcttctctccggggatgagctccttgcggattcatttccgtacactgaacttgagaatggagtgctttgggaagtacaagggaagtgggttgttcagggagctgttgatgtgaacatcggggcgaatccatctgctgaaggtgcagatgaagacgaaggtgttgatgatcaagccatcaaggttgttgatattgttgacactttcaggcttcaggagcaaccttcttttgacaagaagcagtttgttgcctacatgaagaaatatatcaagagcctaacacccaagttaggcgcagagcaggaagaagtttttaagaacaacattcaaggagccaccaagtaccttttgtcaaagctcagtgaccttcaattctttgttggtgagagcatggctgatgatactggaatggtgtttgcctactacaaggatggcgccactgatccaacctttttgtacct

SEQ ID NO: 244 - DNA, 467 bp, Artificial Sequence
  Synthetic
ccccctcggattcttatccccttcaaatcgaggaggattgatgacagcaatgttgcttctctgggcattcatgggtgtttttgctgggtatgcttcagcccgcctttacaagatgtacaaaggaactgagtggaaaaaaattactcttaagacagcactcatgttccccggcattgtttttgttcttttctttgtgttgaatgctctaatttggggagagaagtcatctggggcagtgccatttggaaccatgtttgcattagtatttttgtggtttggcatcgcagtgccactcgtttttgttggtagttatgtaggttttaagaagccagccattgaggatcctgttaagacaaataagatccctcgacagataccagagcaagcctggtacatgaatccagttttctctatccttattggtggcatacttccatttggagctgtattcatcgagctatttttca

SEQ ID NO: 245 - DNA, 465 bp, Artificial Sequence
  Synthetic
cccccccccgaaccacaaactagggttattggcttgctgtttcagtatctattgagcttctctctaccaatcccagccgaagccatgtcgaggagaaagactagggagccaaaggaagagacagtaacacttggaccagtaaccagggagggtgaattggtgttcggtgttgctcacatttttgcctctttcaacgatacttttattcatgtgactgatttgtctggaagagaaactatggttcgcattactggtggaatgaaggtaaaggctgatagagatgaatcttctccatatgctgccatgcttgcagctcaagatgtgtcacagcgatgcaaggaacttggaattaatgctcttcacattaagcttcgggctacaggaggcaacaagactaagactcctggtcctggtgcccagtctgctcttagggctttggctcgatctggcatgaaaattggacgt

SEQ ID NO: 246 - DNA, 475 bp, Artificial Sequence
  Synthetic
caagaagttgctcccagctattggaactgagaagatcagaaatgtgatggacatgaacaccctgtacggaggtttcgctgctgctctgattgaggatccactttgggtcatgaatgtggtttcctcttatgctgcaaacacgcttcctgtggtctacgacagaggtcttatcggaacattccatgactggtgtgaggccttctcaacgtatcctcgaacatatgatctccttcaccttgacgatctcttcacttctgaaagtcatagatgtgaaatgaagtatgtgctgctggaaatggatcgtattttgcggcccaacgggtatgcaattatccgggaatccagctactttgtagatgcaattgccactatggctaagggcatgagatggagctgtcgtaaagaaaacacggaatatggtgcagagaaggagaagatattgatttgtcagaagaagctgtggtattcaaagcag

SEQ ID NO: 247 - DNA, 473 bp, Artificial Sequence
  Synthetic
agccttgtttggatcaccaccatttgtgtctcacccaattgccagaatcaacttctcttcatcctcacaaacccctcctcctcctcagccaccaaatcaacctccacaaccacaaactccaccaccatctcaaaatttaagtgcaacttcttcagattctccatcaccagtcactgcagctaatgtgcagccacaaaagcctagtagtaaacctgcccgcctatcgacaactgcagaatccactgattggattgcctcttccttaacaaggagatttggccttggtgctggacttgcttgggctggttttcttgcttttggtgttgtttctgagcaaatcaagactcgccttgaagtgtctcaacaagaaacaaatacaagggttgtcgagaaagaagaagaagtggtcttgcccaatgggataaggtattatgaactgaaaatgggcggcggagcaactccccggccagggg

SEQ ID NO: 248 - DNA, 457 bp, Artificial Sequence
  Synthetic
atcccgccgcgcggcctctccatggcgtctacgttcgtcggcaactccacctccatccaggagatgttccgccgcgtcagcgagcagttcacggccatgttcaggaggaaggcgttcttgcactggtacacgggcgagggcatggacgagatggagttcaccgaggcggagagcaacatgaacgacctcgtctccgagtaccagcagtatcaggacgccaccgccgacgaggccgagtacgaggaagaagaggacgcgatacaggagtagagactgtctgggcaatggtacctcgtatcccctgcccatcgttaccctaatatgtttgcctgaacatcatcgcagttgcatcaccatagctacctccgcaccttaaaatttgatgcttgtttgtatgcatgtttgtactggttccgtatgctaaagtcttggctattgatgttctgtttgcttgctt

SEQ ID NO: 249 - DNA, 474 bp, Artificial Sequence
  Synthetic
cttcatatttctctctcaagatgcagatcttcgtgaaaaccctaaccggaaagaccatcactctcgaggttgagagttctgacacaatcgacaacgtaaaagccaaaatccaggacaaggaaggaattcccccagatcagcaaaggcttatcttcgccggcaagcagcttgaggacggacgtaccctagccgattacaacatccagaaggaatctaccctgcacttggtcctccgtctgcgtggtgggatgcagattttcgtcaaaaccctcactggcaaaacaatcacccttgaggtggaaagttctgacaccatcgacaatgtcaaggctaaaattcaggataaggagggaattccaccagaccagcagaggttgatcttcgccggcaagcagcttgaggacggtcgtacccttgccgattacaacatccagaaggagtctacccttcaccttgtcctccgtctccgtggtg

SEQ ID NO: 250 - DNA, 484 bp, Artificial Sequence
  Synthetic
cacagatgacccaagtgctgcatggtacttcaagttgaaaaagtgcgtgagtaggactttatctgtcaaaggagaatatgccattgggaaaattccaaaatggccagtgcggctgacaaaagctccagctagggcaagtgttactagaaatggaatggatgtgtttgaagctgactcaagaagatgggcacgcagagttgcattctataaaagttcattgaacttgaaactaggaacttcatcagttcgcaatgtcatggacatgaatgcatttttcggaggatttgctgcagcgttatcatcagatccaatctgggtgatgaatgttgttccagcacataagcctttaacacttgatgtgatttttgacagaggccttattggagtttatcatgactggtgtgagcctttctcaacgtaccctcggacttatgatctgattcatgtgggagccatagaatctctcataaaggatcccgtttct

SEQ ID NO: 251 - DNA, 438 bp, Artificial Sequence
  Synthetic
tctactaaatccagggctggttctgtggtagcaaagtatggagacaagagtgtatactttgatttagaggacttgggcaacaccactgggcagtgggacttgtatggttcagatgcaccttcaccatacaatccccttcagagcaagtttttcgagacttttgctgctcctttcactaagagaggtctgttgctcaaattcctgatattgggaggtggctcaactcttgcatacttcagttcaacagcatcagcggatatattaccaatcaagaaaggacctcaacttccacccaagcttgggccacgcggaaagatctaatttcttttcaatccaactttctcaaccttcattttgtaattgatgtatctgtcaccagcttgtaagtattcttgaagcctacctgagacctttgttacagaagttaaatcttattgc

SEQ ID NO: 252 - DNA, 479 bp, Artificial Sequence
  Synthetic
cccacgcgtccgcccacgcgtccgacggcctgtgtttggatagagccaatcagaatagtttacttgttgaaatcctttagccatggctgcaacgccgagcattcaaggatcatgccttatcaaaaattcttatcaccattcaaattcctccaatgcccagactgaccagcagttaaagcaggtgtttttacatttaccaatttctagaagatctgtaattcttatctctgcgttgcccctgagcctcaatttggttcctcaaccatctttggccagagaaaggcgcaataagaagaacatccctattgaagattatcaaactagctctgatggattgaaatactatgatattcttgaaggaaaaggtcctgtagctgaaaagggctccactgtacaggtacattttgaatgtctatatcgtaatattactgcagtttcaagtcgagaatccaaattgttggctggaaatcgtataattt

SEQ ID NO: 253 - DNA, 481 bp, Artificial Sequence
  Synthetic
gaagagactgtaaccctaggaccagctaccagggagggtgagttggtctttggtgttgcccacattttcgcctctttcaacgatactttcattcatgtgactgatttgtctggacgggaaacaatggtccgcattactggtggtatgaaggtgaaggccgacagagatgaatcttctccttatgctgctatgcttgctgcacaagatgtttctcaacgatgcaaggagcttggaattaatgctcttcacattaagcttcgggctactggagggaacaaaactaagactcctggtcctggtgcccagtctgctcttcgagcccttgctcgatctggaatgaaaattggacgcatagaggatgttactcctattcccacagacagcactcgcagaaagggtggtagaaggggaaggaggctgtgaattcttctcagcaacatacttgctgcatggcaagaatattttggtttcgggtcgcatc

SEQ ID NO: 254 - DNA, 478 bp, Artificial Sequence
  Synthetic
aaaaccttaaccctagcccattctcactccctcgcttccatagtgccgcccaagttcgatccatctcaggtggtcgaggttttcgtccgagttaccggcggtgaagtcggagctgcgagttcactcgctccaaaaatcggtccacttggtctctcccctaaaaaaatcggtgaagacatcgcaaaggaaaccgccaaggactggaagggtctccgagtcacagttaaactcaccgtccaaaaccgtcaagctaaagtttccgtcgttccctctgccgctgcactcgtcatcaaggcgttgaaggagccggaacgtgaccgtaagaagaccaaaaacatcaagcataacggtaacatctcgctcgatgacgtcatcgagatcgctaaggtgatgaagccgagatcgatggcgaaggatttgactggaacagtgaaggagattttgggcacgtgtgtatcagttggctgtacggtagatg

SEQ ID NO: 255 - DNA, 479 bp, Artificial Sequence
  Synthetic
cggacgcgtgggcacgctgtagtctatcgatgcaatatcatgggataccaagatactctctacgtacactctcagcgccaattctatcgcgagtgtgctatctatggtacggttgatttcatcttcggtaatgcagcagtagtccttcaaaactgcagcatttacgctcgaaagcccatggatttccaaaagaacaccatcactgcccaaaacaggaaggatcctaatcaaaacactggcatttcaatccatgcttgcaaaatcgcagccacatctgacctcgaggcgtccaaaggaagcttccccacttatcttggtcgaccgtggaagttgtactctcgaaccgttgtcatgttatctaacttgggtgatcatatacacccgcgtggttggttagagtggaatgctacattcgcacttgagacattgtattatggcgagtatatgaattatggaccgggagcagcggtagggcaacg

SEQ ID NO: 256 - DNA, 485 bp, Artificial Sequence
  Synthetic
aagagagcttactcagttagccagaaccgacacacctttgggaagcctgtcaagatatacaactgaaaggtcttgtaattcactgcccgtgcaatggagctagcaaatgaccctctcattatagaagggacacataaaattttgagagctgtggaatgacgacgaggaaggcagagaagtggcatcaagttgattcagttacataaaggggacttgcttctgttttctctaggtgatttcttcagtttaggctattattcttcctttgattcggttggggaagcgaatgttgtactcgctcctttccttgttatcgtcgtcaatcttcagagttattactctactgagggctgggcctcttcccccgtttatttcaaatcttttttcttttcacgtcttttgcatagaagattttgaagggaatgtatagttgatagtacggcacattctagatttgtgatatctgttaatccttttctcccgtc

SEQ ID NO: 257 - DNA, 478 bp, Artificial Sequence
  Synthetic
gaacttcttaatacaaagatatgctggtcataaaccaaggggggatgcaattgaagcagctcatgataaaataataatgcagaaattctatgataggaaaaacccaaaaattgactttaagaagaaagtcagggacataaaacaatctcgtgttatgcaggctgtcactagcaggttcagaacaccagctacaaatttcattgtgaaaacttctatcgctttcatagtccttggagctctcacagttctctttcctactgaagaaggtccaacgcttcaagttgccatttccctgatcaccgccatatatttcattcatgatcggttaaagagcaaacttcgagcttttctatatggaactggtgcttttattttctcttggcttttggggacattcttgatggtgtctgtgattcctcctatacttaaagggccaacgagtttggaggtgacaacttcgttgattacgtatgtactt

SEQ ID NO: 258 - DNA, 460 bp, Artificial Sequence
  Synthetic
cccacgcgtccgagaagaaatacggagaaagagccatggcaggagcttgcttatcttcttcttcttcttgttggaacttgacttcaaaattcaatatcctttctctcaatggacctcaccccaacgctgcggcattgaagcccctcagcttctctgccaacacttctctcaatctcttctccaaagggagtgtatcgctgacttcggtgcaaatgccgtttcgtcgttcaatcgtttgtgaagcggctccaacgaagaaagcggattcagcagcgaaaagggcaagacaagctgaaaagaggcggctttacaacaaggctaaaaaatctgaggtcaagactcggatgaagacggttttggaagcattggacgcattgaagaagaaaacagatgcacagtcagaggaagttatttctgttgagaagttgatcgcggaggcatattcagcaatcgataaagc

SEQ ID NO: 259 - DNA, 464 bp, Artificial Sequence
  Synthetic
gaattctgaaaatagttttggtagtttggagtgaaaagccatggcatctttggcaacctttgctgcagtgcagcccactaccaatgtcaagggcctagctggaagctccattactggaactaagcttcatctcaaatcatctcgcctcaatttgaagaccactaaatccagggccggccctgtggttgccaaatatggtgacaagagtgtatactttgatttggaggatttgggcaacaccactggccagtgggacctgtatggatcagatgcaccttcaccatacaactctcttcagagcaagttctttgagacatttgctgctccattcaccaagagaggtcttttgctcaaattcttgatattgggaggtggctccacccttgcttacttcagttcgacagcatcaggggatatcctaccaatcaagaaaggtccacaacttccacccaagctcggcccac

SEQ ID NO: 260 - DNA, 460 bp, Artificial Sequence
  Synthetic
ctttatcttgatgctgttgagtcccacaaaggacattgtcatgtatgtgaactccccaggagggtcagtaacggcaggaatggccatatttgataccatgcggcatattcgacctgatgtctccactgtttgtgttggactcgctgcaagtatgggagcttttcttctcagcgcgggcaccaaaggaaagagatatagcttgccaaattcaaggataatgattcaccagcctcttggtggtgctcaaggtggccaaactgatatagatatacaggctaatgagatgttgcatcacaaagctaacctgaatgggtaccttgcctaccacactggtcaaagccttgagaagattaaccaggacactgatcgtgattttttcatgagtgcaaaggaagctaaagagtatgggctaatcgatggtgtcatcttgaatcccatgaaagcccttcaacctcttgca

SEQ ID NO: 261 - DNA, 470 bp, Artificial Sequence
  Synthetic
ttgcctctcatgataggaattgttctgcttgtcctgcaacaattaggaggaaccaatggtgtgatcttctattccagtaacattttcctgtctgcagggatttcttcaagtaatgttgcaacctttggcgttggtgctatccaggttgttgccactgctgttgctacatggctggtagataaatctgggcgtcggattttactgattatctcatctgctggaatggctgttagtctccttattgttgctgctgcattctttctgaagggcttcgtagataaggattctactctttatgacatgttgggaatattatcggtggttggtgttgtgttgatgattattgcattctcacttggaatggggcccattccatggcttataatgtctgagatccttccggttaagatcaaaggccttgctggaagtgtagcaacattagccaattggttctgttcctgggtaattac

SEQ ID NO: 262 - DNA, 474 bp, Artificial Sequence
  Synthetic
agcatggcatcttgggcaactcttgctgcagtacagcccgcgaactgccgtcaatgggctagctggaagctccattattggaactaagctacatgttaaatcatctcgccttaatttgaagtctactaaatccagggctggttctgtggtagcaaagtatggtgacaagagtgtatactttgatttagaggacctgggaaacaccactggccaatgggacttgtatggttcagatgcaccttcaccatacaactcccttcagagcaagtttttcgagacttttgctgctcctttcactaagagaggtctgttgctcaaattcctgatattgggaggtggctcaactcttgcatacttcagttcaactgcatcaggggatatactaccaatcaagaaaggacctcaacttccacccaagcttgggccacgcggaaagatctaattccttttcaatccaactttctcaaccttcat

SEQ ID NO: 263 - DNA, 469 bp, Artificial Sequence
  Synthetic
caagaacatgatgtgtgctgctgatccacgccatggtcgttacctcactgcctcagccatgttcaggggtaaaatgagcactaaggaagtcgatgagcagatgattaatgttcagaacaagaactcttcttactttgttgaatggattccaaacaatgtgaaatccagtgtctgtgacataccacccagaggtctctcaatggcatccaccttcattggaaactcaacttccattcaggaaatgtttaggagggtgagcgagcagtttactgctatgttcaggagaaaggctttcttgcattggtacacaggggaaggaatggacgaaatggagttcacagaagctgagagcaacatgaacgaccttgtgtccgagtatcagcagtatcaggatgccactgctgatgacgaaggtgaatacgaggaggaggaagagtacgatcatgaaggcaactgaagaaatacattt

SEQ ID NO: 264 - DNA, 484 bp, Artificial Sequence
  Synthetic
tcaagtcttcataacgcaactttggaggacaagaatctttcgcagatccctcatttcaggctgcttctgaaacaattaattaccatggaagttattcagtggacatctttatggaatactttcaaggatgagtttgaaaatgaaaagaatatgcttggtggatctttgggtgacaaggcagctgaagatctcagactgagagttatagagcataacattcttgttgtctcaaaatactactcgaggataactttgaagagattagcagatttactgtgtctttctattcaggacgctgaaaagcacctttcagaaatggttgtatcaaaagcacttgtagcaaagattgacagatctgtgggtatagtctgttttcaacctgcaaaagacagcaatgacattttaaattcctgggcttttaatttggagaagctactcgaccttgttgagaagagttgtcaccaaatccacaaggaaactatgg

SEQ ID NO: 265 - DNA, 477 bp, Artificial Sequence
  Synthetic
ggtatgcaaatctttgttaaaaccctaaccgggaaaacaataacccttgaagtcgaaagctctgacacaattgacaatgtcaaggcgaagattcaggacaaggagggaatccctccagaccagcaaaggttgatttttgccggaaagcaactcgaagacggcagaaccctagctgattacaacatccagaaggaatcgacccttcacttggtccttcgtcttcgtggtgggatgcagatcttcgtcaaaaccttaactgggaaaacaatcacccttgaagtcgaaagctccgacaccattgacaatgtcaagggtaaaatccaggataaggagggaatcccaccagaccagcaaaggttgatttttgctggtaagcaattggaagatggccgtaccctagctgattacaacattcaaaaggagtcgactttgcaccttgtgctccgtcttcgtggtgggatgcagattttcgtgaag

SEQ ID NO: 266 - DNA, 494 bp, Artificial Sequence
  Synthetic
gctttctcttctccaatttctttagtttaattttgaaaatgggagtcatatctaccaacaaaaatggctctaatatcttcaagaatggtgccattcccatgaacggctacaagaatggcacttccaaacaccaaaacggccaccagaatggcacttccgaacatcggactggccaccagaatggaatttccgaacaccaaaacgaccaccagaatggcacttccgaacatcaaaacgaccatcataatgggagatccgaacaacagaacgggacaatcagccatgacaatggcaacgagctacagctactgggaagctccaactctattaagcctggttggttttcagagtttagcgcattatggccaggtgaagcattctcacttaagattgagaagttactattcaaggggaaatctcactaccaagatgtcatgctctttgagtcagcaacatatgggaaggttctgactttggatggagcaattcaacac

SEQ ID NO: 267 - DNA, 442 bp, Artificial Sequence
  Synthetic
tggtatgaacgcagagtggccattacggccgggaaggataaaggctggtgtttacagagagaatgtagatgtgccgaagaagaagacgaacataatgttcatgggagatggaagaagcaatactattattacaggaagtaggaacgtgaaagatggtagcactaccttcaattccgccactgttgcggcggtaggtgaaaaattcttggcccgagacataacattccaaaacacagcaggggctgaaaaacaccaagctgtagcacttcgcgtgggctctgatttgtccgctttctatagatgtgacattttagcctatcaagattctctctacgttcactccaatcgccaatactttgttcagtgtttaattgctggcactgttgattttatttttggcaatgctgctgctgttttacaagactgtgatattcatgcccga

SEQ ID NO: 268 - DNA, 499 bp, Artificial Sequence
  Synthetic
ttctgaagttccattaatattatctcaagaagaaaaatgggttacttcgtctaaagataaaatcaaaaccaacagagagtttagaacaaaagtgaatagataaactacagctcctgagaaatgataatggcgattccttccgatacttcttgaaatctatcctcctcatatgttgctagggtacatgaagactctgactctagctcccattgacttgggtggtaggtttgaagtgaacttagaacggacaacaccgctgttaccatgaggcctagtgactttgccccaaatgcaacggtagtgagaaccgttcttctttgtctttgccttgtagatgtaagccaaacgcttacccttgtaccaattgacctcctcttgagtgttcacaccttcaatctggatgagagaagtgttgggatattggttcgacttggacctcttgtagccgaggactgttccacgaacatacaatctaactctctctccttgacgtcccttc

SEQ ID NO: 269 - DNA, 466 bp, Artificial Sequence
  Synthetic
cccacgcgtccggctagtgggagaatccggttgcatcccggagatcgtgaaacttctggaatcgaagtcaaacggatgtcgagaagcggcggctcaggcgatcgctggattggtagcggaaggaaggattcgacgggaactgaagaaagacgggaagagcgttctgacgaatttggtgatgttattggattcaaaccctggaaacacggcgaagaagtacgccgtggcggggctgttggggatgtcgggaagcgagaagagtaagaaaatgatggtgtcgtacggagcaatagggtatctgaagaagctgtcggagatggaagtaatgggcgccgataagcttctcgagaagcttgaaagaggaaagctaagaagcttctttcaccggtaaaacgaacgatgcggagacattgaagcagccaagataaaaagtgtaatattgtctgatgtaagtttattaaccgtt

SEQ ID NO: 270 - DNA, 464 bp, Artificial Sequence
  Synthetic
cccacgcgtccggagaagaatcagagaaaatgccgccgaagttggatccatctcaaatcgtcgacgtctacgtccgagtcaccggaggtgaggtcggagcagcgtcttcactcgctccaaagatcggtccactcggtctggcaccaaagaagatcggagaagacatcgccaaagagacagcgaaagaatggaaaggtcttcgagtcaccgtgaagcttacggtacagaatcgtcaagctaaggtcacagtggttccatccgcagcggctctagtcatcaaagccctcaaggagccagagagagataggaagaaagtgaagaacatcaaacataatggcaacatttcgtttgatgatgtgattgagattgctaagataatgcgtcctagatctatcgctaaggaattgagtggaacagtgaaggagattttaggaacttgtgtctcttttggttgcactgttgat

SEQ ID NO: 271 - DNA, 136 bp, Artificial Sequence
  Synthetic
agatacattaccagattgaagtctgtatttttcttctctttgtgtgtaaatatgaaacgaaggcggtcagattatatataagcttcttctttcttccgttcttatgaagttttatgcaatcatagaagcttcttgt

SEQ ID NO: 272 - DNA, 471 bp, Artificial Sequence
  Synthetic
cccacgcgtccgcaaacatcagaagccctagagcttgagccggggaaaatgtcgaagcgaggacgtggaggaacgtctggtaacaaattcaggatgtcacttggtctgcccgttgcagccacagtgaactgtgcagacaacactggtgctaagaacctttacatcatctctgttaaaggaatcaaaggtcgtctcaatcggttaccttctgcttgtgttggtgacatggttatggccactgtcaagaaaggtaaaccagacctcaggaaaaaggttcttcctgctgtgattgttaggcaacgtaagccatggcgccgaaaggacggtgttttcatgtactttgaagataatgctggagtgattgtgaaccctaagggagaaatgaaaggttctgcaattactggacctattgggaaagagtgtgcggatctctggccaaggattgctagtgctgctaacgccattgtctga

SEQ ID NO: 273 - DNA, 468 bp, Artificial Sequence
  Synthetic
cccacgcgtccggtacaatgtctcctatgtctaccatgccctagatgcctacatcgagagagacaatgtcggcttgaaaggtttcaccaagtcagtttctttagtctaaaggaaaaccgtatttgtgtctcttcagctggtggatcatctttttgttattgttgagggtttaacgctaataggttctttaacgattcaagtcttgaagaacgaggttatgctgagaagtttatggagtatcagatgcattgtttgcgatggagcttgcactgactttggagaaacttattaatgaaaagcttctgaagttacaaagtgttggtgtgaagaacaatgatgttaagctggttgattttgtagaatctgagtttctaggcgagctggtcgaagccatcaagaaaatctcagagtacatagatggaacaaaaataaggtcaatgcagtggtgaagctgagatcggatgtttc

SEQ ID NO: 274 - DNA, 452 bp, Artificial Sequence
  Synthetic
tgactgattactactacttgtactaactctagtacatttacaaaacaagtcctccttttccccaagtatacagataaagatttaccagaaccggttttccgccttcatctcacatggaaatcgtaaggagaagacgcatacacttgatctggaaccactagtggtaacttctcaatgtacataaacaatcgtttctggttctctctagcgattgcagtgagattcactgtatcgttttggtccaaaaacatccagagatcacctgaatctactcttttaaggctgtctctgcaggagttaagcagattgttttggttgggtcgatgggaggaacaaacattaatcaccctctcaatagtattggcaatgctaacattctggtctggaagagaaaggctgagcaatacttggctgattccggtattccatacaccatcatcagggctggaggt

SEQ ID NO: 275 - DNA, 382 bp, Artificial Sequence
  Synthetic
tttccttctctcaccgcgagagtgaccgagagacatgattctgataaactctaattctccgacgctaatctcagccgctagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggg

SEQ ID NO: 276 - DNA, 482 bp, Artificial Sequence
  Synthetic
aatctgcacttacttggcccgacttgactggacgacccacgcgtacaggctcggctatggtccaattctctcccttctctctcttctctttcttcttcttcttcctcgcgccttcttcaatctccgactttcgcttctccagttctgagccttaaacccaacgctgtccagtccaagaacagagtctctctcagtgcttacagcttgaactctagccatggaacaattgtggtgaaggcggctgcttctggcgtggacggggctgagcctgagagcaatgaagaaccaaagactgttgctgctgctgttccagtggataaactaccgatggaatcgaaagaagctaaagagaaactgctcttggaatagaggctgaagatgaagctggccaaaaagattaggctacgcaggaaacgtctggttcgtaagcgtaagatgaggaagaagggtcgatggccaccttccaagatgaagaaaaacaa

SEQ ID NO: 277 - DNA, 472 bp, Artificial Sequence
  Synthetic
cccacgcgtccgaaaaggggaaacctctgcatcaatggcgatttccaaactccatctactctgtcttctctcagtctttctctcccttcatcgtcttgttctttccggcaccgatggagaagaagaccttcttcttacagtattcaacaaatacagaacaggactaaacctaaaaaccttaacaaagaacgaaaacgcagaatgtctcgcagacgaagtcgtagaccaactaaagaaccaaccctgcacaaacactaataactcagctccagtccctggaaataacctcctcgctaaatgcagtctcaacacaaccgtagtcagagacggtgtgatcatgcaagtctgttttcctaagcatgataagaaccctgacttgagcaatttcaacagtgtcgtactcaagaacttgaatgattctaagatcactggaattggtattggttctggtgatatttgggttgttgtcatc

SEQ ID NO: 278 - DNA, 487 bp, Artificial Sequence
  Synthetic
gctcgagaattgcggccgcaaaatccgaaaaggagtgacataacattacaacattaggaataaagtggataaaacattgatcaaaggaaatttagttatagttgaaaatttttattataaaaagggaacgaagggagattttttcaagggcattttggtccaccctcttgagttttccagttgttgtagcaggagcaaacttgtttgttcccatagtaacccggaggcacacagagacacttcctgcagcatttgttgcagaacgtaatgcaagccttgtggtactgtgtctttttacacctcctatcacattccgatgggcattgggtacgtttcaggcttcctggtccataacgtttctggctccacttcacattagatccacttgaggccataaccatggtttgaagcatgaagaggacaatgagggtcaagaggaagatagctccatatgacttagccattttcagtttgggatattgttatc

SEQ ID NO: 279 - DNA, 1314 bp, Artificial Sequence
  Synthetic
cttcttcagggttcaggtgtgaaagctgacgccaccgtggcagctgacggtagcggtacatttaaaactgtggctgctgcggttgccgcggcccctgaaaatagtaataagaggtatgtgatacatataaaagccggagtttacagagagaatgtggaggttgctaagaagaaaaagaatataatgtttatgggagatggtcggacgagaactattatcaccggaagtcgaaacgttgtagacggtagcaccactttccactccgccaccgttgctgctgtcggcgagagattcttagctcgtgacatcactttccaaaacacggcgggtccgtcgaagcaccaagcggtggctctccgtgtggtgtctgatttctccgccttctacaattgcgacatgttagcttatcaagacactctatacgtccactctaaccgtcaattcttcgtcaaatgtctcatcgccggaaccgttgacttcatcttcggaaacgccgccgtcgtgctccaagactgtgacatccacgctcgccgccctaattccggtcagaaaaacatggtcacagctcagggaagaacggatcctaaccagaacacagggatcgttatccagaaatgtaggatcggtgccacgtcggatttacagtcggtgaaaggtagttttccgacgtacttgggtcggccatggaaggaatattcacaaacggtgataatgcagtcggctatctccgacgtgatccttgtcgacgcctcaaggacaagaactcttacatgatatacacagttgttgggtgtctcggaattgctgccttaagtgatcttgtcaatgaggtggtagcaattgagacctgtggaggtcaggtgactgctgatggcactaggaaacggcaaagtggtggtgtattgtggaacatcatcaaagcgagacagcctgaagcttatagagagataatgaaaaagaccaaggagtttgagaaacaatttaggcaaccaaacacgagaccaaaatcagggcccaaaagagatcagggtagctcctccgaaggagttgcctctggaaatgtatctgctgatgaagctctggtgagcgagatgtgtgttatgccggtagctgaccagactgaatcccaacgggaaaaggaaaggaaatctgttcatgagaggatcagggtacctgtttcatatgatgaccttttcagagatgcacctttagatgattctctagcacatcattcttctgcttaagctcattactggatgacttctcttgtggaaagcaattgttttgtcgagaaatggaaagcattgattttgt

SEQ ID NO: 280 - DNA, 1239 bp, Papaver rhoeas
tccatctcagttcgtgttcttgtcattaattaagtcgacgaattcgagaaggctcttcctacctacactccagagatcccagctgatgccaccagaaacctatcccagacatgccttaatgcacttgctccagtcctccctggtcttattggtggtagtgcagatctcgcttcctccaacatgaccttgatgaaaatgttcggagatttccaaaaggccactccagaagagaggaatgttcgatttggtgtcagagagcatgctatgggagccatctgtaacggaattgctctccacagtcctggttttgtcccctactgtgctaccttctttgttttcaccgattacatgagaggtgccatgagaatttcagccttatctgaagctggagtcatttacgtcatgacccacgactctattggtcttggagaggatggtccaactcatcagcccatcgaacatttggcaagctttagagccatgcctaacattcttatgttccgtcccgctgacggaaacgagactgccggggcatacaaggttgcagttgaaaacagaaagagaccctcaattcttgccctttcacgtcaaaagcttgcaaaccttccaggaacctccattgaaggagtcgccaagggaggttacacaatatcagacaactctacaggtaacaaaccagatgtcatcgtgtgtgctactggttcagaattagaaattgctgaaaaggccgctggtgagctcaggaaggaaggaactgcagttagggttgtttcatttgtttcctgggaattatatgatgaacagaccgacgaatacaaggagtctgttcttccagctgctgtcactgctagagttagtattgaggcaggttcaacattcggatggcacaagattatcggaagcaaaggaaaggctattggtgttgacggtttcggagcaagtgcgcctgcaccaattatatacaaagagtttggcatcacatcagaggccgttattgcagcagctaagtcagttatgtagattgttttctttgtccctttttcagctgaagcttatttgtcattttggtttttggatttctgctcttccaaatttagaagtgacacgggaggagagaggcctgtctttaagagtaatttgagttcagaaaaacagcctcgtgaacgaattataataatagattaaaaaaaagaacaaaaaaaaaaaaaaaaaaaaaaaaaaaaaaaactcgagcggccg

SEQ ID NO: 281 - DNA, 902 bp, Arabidopsis thaliana
gaagcacgaacggcgtcgggttagtccgacggaggaaccatgtcctcgtctcttcttctctccggttctactgtatcttcttcgtttatcgctccatctaagccttctctcgtacgaaattccagtaagacatcactgttaccatttcgtaatgtttcgagaagcttcaaaaccgtcaagtgcaccgttgattcttcatatggaggcaatgttcccacgttccctcggacgagagtttgggacccgtacaaacgtctaggagttagtccatatgcttccgaggaagaaatctgggcctctcgtaactttcttttacagcagtacgctggacatgaaagaagcgaagagtctatagaaggagcctttgagaagcttctcatgtctagttttatcagaaggaagaagactaaaatcaatcttaaatcaaagttgaagaagaaagttgaggaatctcctccgtggctcaaagctcttctcgatttcgttgaaatgcctcccatggacactattttcagaagacttttcctctttgccttcatgggtggttggagtatcatgaactctgcagaaggcggtcctgcgtttcaggtggcggtatcattggctgcgtgcgtatattttctgaatgagaagacaaagagcttggggagagcttgcttaatcggaattggagctttagttgccgggtggttctgcggttcgttaatcattcccatgattccgacgtttctcattcagcctacatggacactcgagctcctaacatcactggtcgcttatgtgtttttgtttctttcttgtactttcctcaagtaagttacgttgtggttttatccaaactctttttgttcttttcgcccagacatttacagaacctttcggaaaaattagtgaaagttgtt

SEQ ID NO: 282 - DNA, 1067 bp, Arabidopsis thaliana
ttcgttttaaatagatcttacagtatcactactccatctcagttcgtgttcttgtcattaattaactgcaggtaccggtccggaattcccgggtcgacccacgcgtccgctcaatggagtacaaacatttcagccatccacacactctaaaactccaacagattcagccacataaaagctcagattcttcagtaatctgctcaggttgtgaatcagccatctctgaatccgaaaccgcgtatatctgttcaacatgtgacttcaatcttcatgagcaatgtggtaacgcagtgcgtgggatgcaacatccttctcacgctggtctccaccacttgactctagtcccttacacaacttacagcgctggtaccttcctctgcagagcctgtggctgcactggaggtaaagggttctcttactgttgtcctttgtgtgactttgaccttcatgttcaatgcgctcacctgcctcaggtcttggttcatgagtctcatcctatgcatagtcttcttcttgtctacaacagtactcctcctatgtcttttactcagtttggtttcgggaatcagcttgtttgcaatctttgtaatatgactatggatggtaggttttggtcttacaactgttatgcttgtaactatcatattcatgcttcatgtgctgtgaataagcccaatccagtggctgcttctgctgagaactgtggggcgagtgatgaaggaaagacaccgactgctgaatctgttcctgttcagggtttggagactgagcagacggaacaagtagctgcaataacagagcaagtggaagatccagttttgaggcaacagcttgagcttcagaagcttcagcttgagctagatatgagttctgctctcgcaaacatgattggttccttcaatctcagttctttcgtttgaagtgtctttgtgtttcagtttgtttgattttatgcatttacatgtgttgaattgtctctgttcttgtgttccctaatgtgcttctgatttgaataaatatatcctatctatttggtttaaaaaaaaaaaaaaaaaaaagggcggccg

SEQ ID NO: 283 - DNA, 854 bp, Arabidopsis thaliana
agttcgtgttcttgtcattaattaactgcaggtaccggtccggaattcccgggtcgacccacgcgtccgctctttccttctctcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggtttctacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaatcttcagtgtagtaaaacaaatgtaaattttttaattatggagtttcacttgttttttaattagattatatatagtcgacgcccatctaattcccattttagaaaaaaaaaaaaaagggcggccgctcgaggggtagtcaagatgcataataaataacgg

SEQ ID NO: 284 - DNA, 288 bp, Arabidopsis thaliana; identical to SEQ ID NO: 6

SEQ ID NO: 285 - DNA, 452 bp, Arabidopsis thaliana
tgactgattactactacttgtactaactctaatacatttacaaaacaagtcctccttttccccaagtatacagataaagatttaccagaaccggttttccgccttcatctcacatggaaatcgtaaggagaagacgcatacacttgatctggaaccactagtggtaacttctcaatgtacataaacaatcgtttctggttctctctagcgattgcagtgagattcactgtatcgttttggtccaaaaacatccagagatcacctgaatctactcttttaaggctgtctctgcaggagttaagcagattgttttggttgggtcgatgggaggaacaaacattaatcaccctctcaatagtattggcaatgctaacattctggtctggaagagaaaggctgagcaatacttggctgattccggtattccatacaccatcatcagggctggaggt

SEQ ID NO: 286 - DNA, 564 bp, Arabidopsis thaliana
cacttaaaacactgatttattctctttccctcttcttatttcaacggcctatgtggaaagtttttgattgagaatccaaatcacacattacatcaaatcagaactcattatgagtcactaacgagttcagacatgtcgcggctgatgctgttctcatgtgtggacaatggagttccagatataaaagccttgaagagcgcaagagcttgcttcggtctgtgcaaaggaacttcatggcctgcacctctcactgtcacaaagttcagaccagcatactgctgactccaccctcccacctgtccatctaagtaccaaggaccataggcactcaaaggacgaaggtttagtgcatcgatactgtaccgggttgatgtgactggtacaacggcatctgcgtccccactgaaaacccagatacgaagcccagcagctataagctcgtggtaaatgtttagaaccgaggaaggagagtcattccagtgttcactcacgacatcactgcaagtatcccattttgatggtgcaagtcctggtgggacatggagggcttttcggacgcgtggg

SEQ ID NO: 287 - DNA, 403 bp, Arabidopsis thaliana
ttttgaatgaataaaagtcttataattatgatgtgtgtacaactacaaagttttccttggagtatagtttgaggatttatccagaagtagcagaagaagcagctacagactcggagagttcttccatgagttccttttgctccaaagcagcacaagcctgcactgcgtcctctaaagcaccgtcaagaaatgttgtaagcgcaaagttcatctttagcctatgatcagtcactctactgtccttataattgtatgttcttatcttttctgaacgagctccagtcccaacctgagatttcctttcattccttatcttctcttgttgttcccttacttttatttcatacagttttgctcgcagaagctggaaagcacgcgccttattcctaatcggacgcgtggg

SEQ ID NO: 288 - DNA, 233 bp, Arabidopsis thaliana
acattaacaacgggttttatagatttaatcaaatatgatccttacaaaccacactgagaatagttatacgacatagatacagttgctggttaaatagcaaactcagttacggcatatcttggcggtaggcattgtgacacagactggagcatacttcttcttggcagcttctgttcctctctttggctcatcgtctgccattgccaccttagctaaggagcacacagctgcag

SEQ ID NO: 289 - DNA, 244 bp, Arabidopsis thaliana
aaagagtacaacaatgttgattaacttagttcctctgtacattgaagattccaaatttgttcatggagctacaacggttcaacaataattcaagctcaaaaaccaagaactctaagatgaaacacactcacagacagacatgaaagtgatggaagatagataggtatgagatcataagtctgtcttcactctttagttgaaggtttggacaatagtgttgtgccatgggtcagacaagtgctgc

SEQ ID NO: 290 - DNA, 620 bp, Arabidopsis thaliana
tatgtgagagatatagtaactacaactgaatgaaaaatccatgagacaaaaaagttcgcaatagaagaatattgattcggtaacaaagcacagcttataagttttcttgtgttaaagatgaaccaatttgaagcattagaggataaactggactaaactctttgtcccctctcgatctgatcttcactgcataatcatccaaagttgcttttatccctttccagatctgatcctctctttggttatcaagccacagtgagtactgtttaggacttagtctgttcttctgcatcggtgactctaactcgtctgggcctcttgtgtagagatgatgtaggacgatgctcggtggtagatcattgatgagaggagatgatcccatttgagatgtttccaggaaaaccaaaggcctaaacgctctaagagctctgtacggtgctccgagttgttccacgggaaatagattctgtcccactgctagttccagctcggccatgtctttggccattctgagttttccccattctgaaagtggtcgcacaagggatgcatgtctgatgtagaagatcaaaacccttgacgccatttgtcttgtgagtcttgtgcagatcgattctgtt

SEQ ID NO: 291 - DNA, 367 bp, Arabidopsis thaliana; identical to SEQ ID NO: 26

SEQ ID NO: 292 - DNA, 1132 bp, Arabidopsis thaliana; identical to SEQ ID NO: 29

SEQ ID NO: 293 - DNA, 701 bp, Arabidopsis thaliana
cggccgccctttttttttttttttttttttttttttttttttccaagcgaagggcttccatattctttttttggaaaataaaaattgcatgtgcaatggtcttcacacattccagatattaacacaaagtattgaagcacgaaataaaataaggatagattgaaaagaaaaaaatagaaaacacaccactatcaatgcgcaacccaaaaccctatcagaccagattctctacaacatcctacggtcatcatcacaccctcacactcgccctttcccttcttattcgatgcattggtccaatcaatgccttggtccaacgttgctgccacaatgtctcctgacatttgtgttcatgttttggggctaattgtatatttttaccggcttctcgtaagcatggcggttctggtttgcagcataagccctcttaggagtagtgtcagcatgctccaacccgaggtactgctcaaaagcaccatagacatctcttctctggaagcgattataaacaacatctgtgtcctgcaagtactctggacgccccattgacatgaacgcaaacttccacttggcaaaatcttcatcagatacatgaagcttcttttcggacgcgtgggtcgacccgggaattccggaccggtacctgcagcgaggggtagtcaagatgcataataaataacggattgtgtccgtaatcacac

SEQ ID NO: 294 - DNA, 1612 bp, Arabidopsis thaliana
cgtgttcttgtcattaaagcggccgcccttttttttttttttttgaaaaagcaggaatgaataatacaatttgccaatgccaactgtctcacaacaagaacaagatgtctctgatttaccacaacaaacacaggatggattcagatcttattgattgtacaaatttgcgaaaggaagacttgaatgggctgtgttgagaccctcataactcatctcgtgaaccacttttgctttcatatgatgcataagctttgatgattgaaacatacacctcaatgcctttcaagtactcagctttacccaaatactcattgtggtcatgaagcagactcggggtgtttgatatgggagagaacccaaaggcaggcacgccagccttgcgaaagtagcgagcatccgttgatgcagggaaaatctcaggcttactggtcctacctccggcttccttaacagcattttccaagagcccccaccaaggatttgaatcatctgctgctgtaaggaattgcttccccgtaagcttctgcttgaactcaaaggacatgtttcgtgctgctggagcccattcctccactaaacgtctttcgagtgcttcagcatcaacgctgggtggaacacgaatgtcgaaaccagcttctgcctcagatggttgcagattcattacgaaaccagttggagaaggtgtgccagccttgaggaaggccatgttcacagagacaacatcgccttcagctatcccaccagctttgagaagatcgaactgagaagctctgaatctgcgaatactctcaatgcttttgagcagattctccatggcagagttgtcatagagcttggcaccgtggccaggtggacctttagccttaatcaccagccaccagggactcctctctccatagaatactctgtaactctcagtaggcgatggcaggccttcgtcgagcacgattgcgatgttcaagctcttgaataattgggattcagcaaacttctctgcgccatcgtggccgccaatctcttcatcggggacgaaggagagatagacggatcggagtggcttgaagccagaagcctggagcttgcgtatggcctcgaggtactgcatcccgacgcacttcatgtcctgggaacccctggcatagatgtcgccatggtggtccatgtgagcttggagcggatggtgagtccacttggagtcctcgaagggaacgacatcggtgtgggagttgaggagaaaggcaggtagggttgggtcggagccaacccatttgaggaggagaagcggctttccttttacaaattcgatcgtctgagattcgagggacagtggtttcgcctgagatattataaagtcaacggctttgtagtattccgggttgggctgaaccgtgttgattcggaggtactcctggaatctggagacgatggcgtcgtcgccggccaccgcagaaagatgaagaacaacaacaacgaggagaagacgaagaagactcattgaattggattcggattcttccggacgcgtgggtcgacccgggaattccggaccggtacctgcagcgaggggtagtcaagatgcataataaataacggattgtgtccgtaatcacac

SEQ ID NO: 295 - DNA, 246 bp, Arabidopsis thaliana
ccaaaaaggttcaaaatcataacacaaaacaaaagaaataaacaggaagctcgagtgccaagtacctccgccacctccgatcaagaacccaattccgagaattgagctccgacggagaataaacgaagcggtaacacaaacaaccaaccaaataccaaactactaaagtaaagaaactaaaatagtccttcatttcatcagcggaaagagttttgatgttcagagttcacttggcacccttcttga

SEQ ID NO: 296 - DNA, 604 bp, Arabidopsis thaliana; identical to SEQ ID NO: 46

SEQ ID NO: 297 - DNA, 161 bp, Arabidopsis thaliana
ttacttgataaggaaagtgtttacaccaaaagaaaaacaaatacaagatggttcagcaacaaataacagagattaacaacatctcgaggaaacaacaaggaagagaccataaatcaatagcgggttttttcaagcagatttagcagcttcagctgcttctt

SEQ ID NO: 298 - DNA, 225 bp, Arabidopsis thaliana; identical to SEQ ID NO: 49

SEQ ID NO: 299 - DNA, 698 bp, Arabidopsis thaliana
ggaagaaacccttatgtatatgattgctaaaggttgaatacacatcacactacatacaaatcattctccattcccaggttccagtaaacacaacaaacaaaaacaaacactgagaaaggaaaacaaaaattgtctttcttgtttcatcactgatcaatgaactcgaactcatcttccttaagatgtgaaacaaatttaacaagaccacgaccttcaatttctttgaagaactcaatcttataaggaagattagctgagattcgtttccctttccaaacagcaacgtaatctttgagtttaccttccataccttctaaatcaacctctggaactcgatttacatgataaaccttcaacggtgcagttactctaaccctagatcctatcttcgccttcgcttccgcttcgatttcttcctctgatgacggtgaggacgaaggattggcgtctgcgtttatcgaatctgcggattttatcgctacatcgcatcgaatcgtggttcgagaagtttttcttgagcttgagtgtttgatttgagattgagaggtgaatagcgagagaggtgcgacgatgcaagatttgagagccatgggggtggcggtagcagtagtggcggaagcggatagacagtcgtgagaggacggacggcgaatggcggcggcgatggccggtgacaaagcgatttggctactcatatc

SEQ ID NO: 300 - DNA, 416 bp, Arabidopsis thaliana
atctgaagtctggcaagtcatttatcaaactcggcggagccaaatgacaaagtagacccgcacggtcattgaatagtacgtgtacaacataagcagtgttcaataccagtatttgtctctctcttcgttgaacaaaccaaaggatctgcaaatcatcactctctacttccgatctctccgcttcctttctgctctcctcttgtcgtcttcccattcacggtcatagattgggtcaggatcacgacgagccattttgctggaagcttcttttccaagaagtctgatgcttggctcttcaagataacctccgtgttgaatcatactactgctcttccgctctctgccttcgtacgatgatggtcccatactggtcgataaagacgaatgatgtggcataggagagtattctcctggct

SEQ ID NO: 301 - DNA, 274 bp, Arabidopsis thaliana
ctagaaggttgtttcccatattatatctaaactgagaagatgaagtcgtgagacagcgttgtctagatatatttgcacacaaggatttaaactccagatgatcaatcgaacatcatcattcatcgacagacaccattgtttttactttaaggtacgaaagaaaagcttgaagaccaacaatggagaagcccctcaaaggtaggctttgagagtattagaagaaagttccttcgggaggttgaacaagcttccggttatgcgatgcagccatctc

SEQ ID NO: 302 - DNA, 429 bp, Arabidopsis thaliana
caaacttatttgttgtatctaaatatattacaaagtttcaacccaaatttacaatcttctctggagagatacttcataaagcaaaaaccataaagttctaatcaagagaatctcactctacttaattaacaaagatcttttttaaaacatccttccaagctttgtgatgagtatgcttcttcaagacttttgattctgctgtttcttgtttttaaagttttaataagttcctcttttaagttggttcttgtggacgagctgcccaaagagaactaagagcacgaagtctatgaagatactctcctaaagctagtaaacctcgagccgattgtcttgtcgttaagatcttcgccatttgttgcaaagtttgttgcctcagatgatctgcttgattcacaaatccttctaatgcttgaagattctctatag

SEQ ID NO: 303 - DNA, 586 bp, Arabidopsis thaliana
ggcaacacaaaacttaaaaaaacaaaagcaatatttttttcaccgacaaaaacaataagcaatacacgcaaaagtttaacaaatccagaaccgatatagggtttcaataacaaaaacgaacacacatgaacgaaacaataaaagagatattacgaagaaaaaaattcaggataaggggaaagaagaaagtgaatgctgcttgcttacacagcttacgaatccgagggagccattgacaacatcttaagtctcgtactcctcttcttcctcctcgtactcttcctctccggctgtagcatcttggtactgctggtactctgcgacaagatcattcatgttactctctgcttcagtgaactccatctcgtccatgccttctcctgtgtaccaatgaaggaaagcctttctcctgaacatagctgtgaactgttcgctcacacgcctaaacatctcctggattgaggttgagttaccaatgaaagtagacgccattttcaaaccctttggtgcaatatcacagacactggacttgacgttgtttgggatccattccacaaagtaggatgagttcttgttctgaatgttc

SEQ ID NO: 304 - DNA, 590 bp, Arabidopsis thaliana
tcttcgagatattaattagtatggttccatagtttttgtccggtatacacatttaaaactaaaccaaaatccgaaccggacattttctcttacagttaggtataacaagagagaaaatgacatgtacaagaaatgtgaaggaagattacatggattggattgctatgaacattggtttgggttctggtctagtaccagttttagactccttaaccgggactactgcatctggaactctttgacatatgttcttgatagaaaggatcatcagagccttgaactgaactcagtcttggagatgaaaaactgtatccttccttatgcattgcctcgtggcagctttcttcttctttgaacttgatgaagtagatggatgaccagtaatctcttaccaagttcatcttgatcaattgcatgacttcgtttaatgcgttcttgaagagatcagtgtgagttagatcttgagtggttaagatctcttgtcgggttttatgagataagttcaattccatttccgctcctgcgacgatgaacttctccatgatatgtcgagccatgtagattcttcttatcgaatccggacgcgtggg

SEQ ID NO: 305 - DNA, 462 bp, Arabidopsis thaliana
tttttagagagtcaaattagaatcttgtttcaaataccatcttcaaatgcaagagatagtaagagagctcaaaaggttaaaccaagaaagtaaaatgacattattaaggtcgacgagaatgtacaatcatcaagaggatcagacgtagaagctgaggtaattagcagtagaaagatccaccaaatgtgttctctccactgtatgtcatgtagagaaacccgtcttcgtctttgtgttcttcgtagattgcagacatcaatgccgcagttggtggtaatgtgttcttgacaaagacaaagatggctttttcagctccaagcttgattcttttcctcacaacgtacacaaattggccaatggttagatcagctggtacaagatacttcttcttgtcaatgtcaggaacatcactctgtccagcttttccacaatcacgggaactctttcaggcggacgcgtggg

SEQ ID NO: 306 - DNA, 691 bp, Arabidopsis thaliana
tgggtttttgttttgaactctccttatgtattaccgcctcgccggagactgatacagtttcttctgtccctcattgaaagaagaaaagaaaacaaaaatagaaaaaaaaagaaagcagaaaaaaagcctaggaggaacaatgaatttagaaaaccaaaccatgacagaaaagtctgcgggattctctggttagctctaggtgatgatatgatcaagtttcgtcctcactggctttgtatgaagggaaaagaagataatctaaaagattcgccaaaagacacagatcgttcaccgtgatggctcgcctacaatatcgtggtaaaacaaaaacgattgtactaagtagcaattcctctgtttggttgtctcttgttcacactgtaactgccaacataacctggagatgaacttctagctgaaacatctgaagaaggaacccctcctccaatcccatagctaaaaggagcaggcccttctgtctcaggagttggtgatctccatgtagggtcactataaactgcaccattcccgtaaaactctgcaagtcctgctgtatcataacccgtgttgttggttgctgaggcagaagagaatgaagaggatggtgctgccttgttagcccctgggtttcttgctgcataaccacctgttcccaacccaaaaccagattcaccgtttccggacgcgtggg

SEQ ID NO: 307 - DNA, 611 bp, Arabidopsis thaliana
cgcaacagccgctggcgatcatggtgccggcgtggatggagtacgacgtcatcgcgcagatggtggagaacatgatcaacgtactcgattaccgcgagtacgtcgtgttcgtcggcacctatcccaacgaccagcagaccatcgacgaagtggagcgcatgcgccgccgctacaagcgcctgcgccgcgtggaagtgccgcatgacgggccgaccagcaaggccgactgcctgaactggctgatcctggccatcttcgattacgagaagcgccacgacatcgagttcgccggggtgatcctgcacgacagcgaggacgtgctgcacccgatggaactgcgcttctacaactaccttttgccgcgcaaggacatgatccagttgccggtcacctcgctggaccgcgagtggtacgaactggtggccggcgtctacatggacgagttcgccgaatggcatgccaaggatctggtggtgcgcgaaagtgtttccggcatggtgccgtcggccggtgtcggtacctgcttctcgcggcgcgcgctgctggcgctgagcgcgcagaccgacaaccagcccttcaacaccgacagcctcaccgagcggacgcgtggg

SEQ ID NO: 308 - DNA, 341 bp, Arabidopsis thaliana
tttttagagatctaaagcatgatcgttcatagaagcagagaattaatacaaactttctggtacttttagtatatacataactttgtccatatctagtctcttggcttattatctgccgtacaaattttatagattcagtaaccttgaaagagcctagcatagaagcctaagcaaatttgatggtttaaacagttttgtagagctgtgatcgtgtgggtgcatgaacttgcagttgggacaaacaggagttgatgtacacaacataaccagcatgtggcatttcatgcaaactgttgttaccatctcttgccccttgtgatcaacatcgtcggacgcgtggg

SEQ ID NO: 309 - DNA, 552 bp, Arabidopsis thaliana
agcggccgctcgcgatctagaactaggcttttacgaacagagagcgagccagagagagtgagtaagagagaatgacgagcgtgagtgggtgtggttcagtgagtctgataactaaccgcagtgcgttcttgggaaacggacttcaacaccgtgccgttttccttaaaccatggtcgtcttcttcgcttcagtctcggtccatggttgtcgaagccaaaaccaaaaccagcagcgaagacagaatcgcccgccactctcgtatccgtaagaaggttaatggtacaacggagaggccaaggctatgtgttttccgatcaaacaagcatctttatgttcaagtgattgatgataccaagatgcacaccttagcttcagcttccactaagcagaaaccaatctctgaagagttcgactacacctctggaccaaccattgaggtagcgaagaaagttggggaagtgatagcaaaatcttgcttggagaaaggtatcacaaaggtagcctttgaccgtggtggttacccttaccatggacgtattgaggctcttgctg

SEQ ID NO: 310 - DNA, 626 bp, Arabidopsis thaliana
agttaaatggtttgggatttaagaaagttttcttcttataacagagttggtaaatttaaaatacaacggaatataatcgaaacaatcagtgaaactatagagatatattgatcacttttcaatttttcatgacccaaaacctctcaatttctccagcggttcttcctgggatcctcccagctatcagttcccacctttcatcaaataataacacacaaaattcagcttttactatggtgttacaattaaattattttcctacgaaatagtattcattattagttaaaagatcaaacctgtcaccgacaagcttatgcattcgagagaccaaatcttcttcttcttgactcatgttcacaacttcccactcaagactactcacttctgttccttgtcatcaccaaaattcagatttctcattatatatagataagtataaaaaaacatggaaaaatgagaaaacgaaggtgtttaagttttcagcttaccttcagaagaagaagtaacgatggagttggtcttgggttgcttagtcctgcgatggttatccatgtcaaacggcaccgtattacaaagaagaagaagaaagaaactaagagagtactctgagagagcggacgcgtggg

SEQ ID NO: 311 - DNA, 796 bp, Arabidopsis thaliana
ccgccctttttttttttttttttttttttttttttttttttttttttttttttttttgaaaatgtggagggagttttcaaactttgctaaggaaggagagattttgatccgttagatatcgaacaacataaacgcaaaacctaatccaaccctaaaacacgaaattagggaaaacgaaagatatacataagcataacgatcacagtctagagtacttcaatctccttcttaagccctctcgcctctaattctcctcgccaattgaatatccttaggcatgatagtgactctcttagcatgaatcgcgcaaagattggtgtcttcaaacaatccaacgaggtatgcttcagccgcttcctgaagtgctgcgacggcgctgctctggaaacgcagatctgttttgaaatcctgagcgatctcacgaaccaaacgctggaacggaagcttgcggatcagaagctcagtgctcttctgatacttcctgatttctcttagggcaacagttccaggacggaatctgtgtggcttctttactcctccggtcgccggagctgatttcctcgccgcctttgttgcgagttgtttccttggggcttttcctccggtggatttccttgcggtttgcttggtacgagccatttggtatccgaagctttgagatttgtgattaagtgttgaagatttgtgagatttgatgaagcggacgcgtgggtcgacccgggaattccggaccggtacctgcagcgaggggtagtcaagatgcataataaataacggattgtgtccgtaatcacac

SEQ ID NO: 312 - DNA, 921 bp, Arabidopsis thaliana
cccttttttttttttttttttttttttttttttttgataaataagtaaagactatcattcattaaccattattaattcctcaactaaagtcattagaaaaaaagaaaggctaattaattaactcgaagatgctggctggggttaaaaaattaacccaggggtttggttacaaacttcttacatcacggacggggagggttataataataaaggaaacttaacggccgtcagcgagagggttaacggcagattccttgcaaggacttggaggtagacttgactttcctgacgcaacaagacgttgcacgaaaccctctattctttctccgttactctccgttagtatccgttttaccccaaacggcgccgtttccacacctctctctttcagcaactcctccgctccgccgctcgtcaaaccgttcgcctggattctaacgtaatcagtacggttccagcagaaagcgttccccagcatctgatcgacggtatcggaaacgccgtcaaccactatgtccaccacacttgacgttgaatagtctccgttacgacggagtttcctccctggtgatgatgacatggtcgacggaccgtttcccaacgacagtacaagcaagtcatctacgccgtttactgacgggaaatctcgtttgttgtgtagcacgtgcgtgacggcagctgctgttggattgttcatcaccaaaccgccgtctacggctgagcatgaggttttcccgtccaccgacactacactgaacggcttgaagaggcttggtgttgctgacgtggcacggcagactttccacagctcgaagtcgaagctcgcggacgcgtgggtcgacccgggaattccggaccggtacctgcagcgaggggtagtcaagatgcataataaataacggattgtgtccgtaatcacac

SEQ ID NO: 313 - DNA, 1113 bp, Arabidopsis thaliana
ttttcatctcgtttctaatactacgatgatctagagaaagtacacaacccaaacaaaacaaagaggacaacacgatttgcttcatacaatattaatcaataatttttgtagccaacaatacgtaggaacacattacacaacaatctctcaaagaccgagcgagaaggggaaaccggtcgacgataaccagcctccaccaccaataaactgaccagccgtatatttttgagcttcagcagcagccgtaattaccttaaagcccctccacttcactctatttgcagttccagcccctgctcctgtgttcgaatactctctgtaagtcagagtgttcaacgcaaaagtcccggtccactcggaccacccttcgggtcggatcacgtcggagatagccgactgcattatcaccgtttgtgaatattccttccatggccgacccaagtacgtcggaaaactacctttcaccgactgtaaatccgacgtggcaccgatcctacatttctggataacgatccctgtgttctggttagggatccgttcttccctgagctgtgaccatgttttctgaccggaattagggcggcgagcgtggatgtcacagtcttggagcacgacggcggcgtttccgaagatgaagtcaacggttccggcgatgagacatttgacgaagaattgacggttagagtggacgtatagagtgtcttgataagctaacatgtcgcaattgtagaaggcggagaaatcagaacccacacggagagccaccgcttggtgcttcgacggacccgccgtgttttggaaagtgatgtcacgagctaagaatctctcgccgacagcagcaacggtggcggagtggaaagtggtgctaccgtctacaacgtttcgacttccggtgataatagttctcgtccgaccatctcccataaacattatattctttttcttcttagcaacctccacattctctctgtaaactccggcttttatatgtatcacatacctcttattactattttcaggggccgcggcaaccgcagcagccacagttttaaatgtaccgctaccgtcagctgccacggtggcgtcagctttcacacctgaaccctgaagaag

SEQ ID NO: 314 - DNA, 794 bp, Arabidopsis thaliana
cggccgccctttttttttttttttttgtgtatttaagaaatcttggtagttggtatatatagttttgtcaatgcatttctcgacaaaatcaatgctttccatttctcgacaaaacaattgctttccacaagagaagtcatccagtaatgagcttaagcagaagaatgatgtgctagagaatcatctaaaggtgcatctctgaaaaggtcatcatatgaaacaggtaccctgatcctctcatgaacagatttcctttccttttccggtttggattcagtctggtcagctaccggcataacacacatctcgctcaccagagcttcatcagcagatacatttccagaggcaactccttcggaggagctaccctgatctcttttgggccctgattttggtctcgtgtttggttgcctaaattgtttctcaaactccttggtctttttcattatctctctataagcttcaggctgtctcgctttgatgatgttccacaatacaccaccacttgtccgtttcctagtgccatcagcagtcacctgacctccacaggtctcaattgctaccacctcattgacaagatcacttaaggcagcaattccgagacacccaacagctgtgtatatcatgtaagacttcttctccttgaggcgtctacaagtttccctaacaaaccagtctacactcatgggtttgtccatcacagggccttttctctttttcttcttcttcttcctcttgttcttgtttgtctgctgcagcgaggggtagtcaagatgcataataaataacggatt

SEQ ID NO: 315 - DNA, 644 bp, Arabidopsis thaliana
gatatctttacaatttcgcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgatatctgcagc

SEQ ID NO: 316 - DNA, 1077 bp, Arabidopsis thaliana
cgccctttttttttttttttttaattcgacaaccaacttttaaataaataaaaaaaactcaacaatagagggaaataaataatcctcatttactctcccccaaaaaccataaataaaagattcacaaaaaaaaaaaaacatggaagaatcgaagaaacaagaagtgaaactatagaagccaagaagaagcaaacaagcagagcaagctcaccaccaaaccagccttagctcctccgatgatcctaaccgcaccagcatcatctgccgtcgcatcatcggcctctccgtcaggcccttcggcaggcgaatccgagtcaccaaaaggatcattatctggcgacggtgcagccttcttcttctttcctttcgctttccctttagccgcttttggagaatccgcaacatcaccatcctctggtgccggagcaggagccggagcttcaacagccgaagccttaaacaactctttaggcaacaaaaccttatcagtcgcatatatagctaaaggctgctcatcaataagagtatcaacgatcttgacagtgttgatccttgtcttgagggtaaccttctctccatcgttctgtacagtaagctcaaacttgttagctccatctgtcgcaagtgtgttcatcggaccattgttggatttggcatcgccattgagtaatatgtcgggacagcgaggaaatcgagaaatgcttctttctttggagctgtcaagttcttgtatttgggcaagaaacctttcattgcatcatctcctggacagaacactgtcatgcctccttctaaactctcctgataggtttttgaagctccagggttagtgagaagagtctcagcaaacactttgcatccatgagccgacattattccggtaagattcatctccgccggagcaggagtcggagccgccgcagtctccgacggtaaaactctactgatctgaataatggagatgttatacggaacttcttccggacgcgtgggtcgacccgggaattccggaccggtacctgcagcgaggggtagtcaagatgcataataaataacggattgtgtccgtaatcacac

SEQ ID NO: 317 - DNA, 1003 bp, Arabidopsis thaliana
ggccgcccttttttttttttttttttaatgcttttctaatcaataaatatcaaattatccaccagataaaaataataatttaaaaagcgtattctcaaatcgtaacaaaaagggatatttttggtgtttgtcacccaaaagtataacctatccaatgagggtatgaagaaaattgagtgaatcaaaatataaaagataaaaaaaagggaagacgaagcaaaactcttttgtatgtttcttctcattagcaaaggctggggtaaaacttagaagttgacttgaaagccactgcgtctgcgatgacctgcaccgccttttgatctgtttgagtttctttcatattggtatcgcatccccaaacccttaccgcaagcctacgacatttgggtgatgattctctgaaataggttttgtaccaactgatcacatctttcttctgtatacttcttagttcttctgcttctttgtgggagaaatcaaacatgtaccttttgtcaacaatctgactccataagtcatttgtctcggacaagagagagggatccttttccagcaatctagcaatcataccacttcggtaatcttcataggattcatcatccagttgttccagaagcccttcgatatcttttatgaaattgtcaactctccccagcaaatgaactggaccgtacttagaagattgaacacagaaacagaaaccgtgcacacgatacgttaagcgagggccacactcgacaacataaccaagctgctcctttgtcctcaactgattgaacaatggctcttctatgatttcatgaaagagatccagcacagctttcgttctcgttgattgagcttcttcaggctcgatttgatagtaaagctcgactactgagtttgtttcagatttgttcttcacattcggacgcgtgggtcgacccgggaattccggaccggtacctgcagcgaggggtagtcaagatgcataataaataacggattgtgtccgtaatcacac

SEQ ID NO: 318 - DNA, 449 bp, Arabidopsis thaliana
tttaaaatataaataaaagcctaaaacatcatttatttaatcaaccaataaaaataattttgcattgaaaatttaaaacatcatttatttaaaaaccaaaatgaaagctttaaacatcatttataaaaagattggaaggagtatatttttatttggacaaagaagataatgcttatggaatgtctcttacttcaaatgcaaacctcggtagtacctgtaagatacttttttaaataagtgacttggctgcttcaaccatagcttcaatggtgataccaaactctttataaagctttcctgctggtgcacttgctccaaacgtatcaattccaatcgatttcccttttcctccgacgatctttccccatccaaaagtcgatccagcttcgatactaactctagctgatacatcagatggcaaaacactttccttgtatcggacgcgtggg

SEQ ID NO: 319 - DNA, 554 bp, Arabidopsis thaliana
cagttcgtgttcttgtcattaaagcggccgccctttttttttttttttttttttttttttttttttttttttttttttttttttttttttttttttttttttttttttttttagatgaaaaatctaactttcatcatcaatattacaccaaagctgctatagaatgattcagatagtatacattgatttatacacaaaaatatcccaatgatatgcagacaaagataaattaaaaaacaggtcaatcttgcttgcgagtatttggggaaggagtgttgagagacaaaccaagatctctacataactcttcatcgggctgcaagcttccaggtatagcaccaaaagctgttctggaagcttcaaatccagacgccaagaaatgaatatacgctgacatatcctccaagtttttccccacactaatcgaagatgacgcaaacacacttctctttgacaagcggacgcgtgggtcgacccgggaattccggaccggtacctgcagcgaggggtagtcaagatgcataataaataacggattgtgtccgtaatcacac

SEQ ID NO: 320 - DNA, 908 bp, Arabidopsis thaliana
ctcaaaatcttaaaaactttctctcaattctctctaccgtgatcaagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctccgtggaggtatgcagattttcgttaaaaccctaacgggaaagacgattactcttgaggtggagagctctgacaccatcgacaacgtcaaggccaagatccaagacaaagagggtattcctccggaccagcagaggctgatcttcgccggaaaacaattggaggatggtcgtactttggcggattacaacatccagaaggagtcgacccttcacttggtgttgcgtctgcgtggaggtatgcagattttcgtcaagactttgaccggaaagaccatcacccttgaagtggaaagctccgacaccattgacaacgtcaaggccaagatccaggacaaggaaggtattcctccggaccagcagcgtctcatcttcgctggaaagcagcttgaggatggacgtactttggccgactacaacatccagaaggagtctactcttcacttggtcctgcgtcttcgtggtggtttctaaatctcgtctctgttatgcttaagaagttcaatgtttcgtttcatgtaaaactttggtggtttgtgttttggggccttgtataatccctgatgaataagtgttctactatgtttccgttcctgttatctctttctttctaatgacaagtcgaacttcttcttaaaaaaaaaa

SEQ ID NO: 321 - DNA, 476 bp, Arabidopsis thaliana
gcgcgtcttggttgtaaacaccgacccttctatcgtgtagttgtcgccgatgaaaaatcgcgcagggacggtaaacaaatcgaggtgttaggcttttatgatccactccaaggcaaagaagatgcggatagagtgagcctcaaattcgacagaatcaagtactggttatctgttggagctcaaccaacagacacagtggaaagcatgcttttcagggccggtttgataccaccaaagcctatggtagtggtcggttcaaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgtt

SEQ ID NO: 322 - DNA, 713 bp, Arabidopsis thaliana
cgcgcaatgacatcatcaagcatccacatatccacctcggaaacggactcatcaagctgactcggttgctccgccgtgttaccgtccagctcaaggaacgattccaagctcgatatctgctgtttcagatcataatccggctcaaatccgtaactcaggttctgaaactcgtccccatttccaaatcctatacactccaccgggaaactcggctgacttaactcgctctcactctgagagacaacgcagaccttcttcgccggaggctgatcggttgatcgtggcgatgacggcggaggagtataattaggaggaggaggatggtgcagatctgggaagttgagcttggctttatcaccacggatctgcttggccgcaacatcataagccatggcagcttcctccgccgtgttgaacgtaccaagccaaactctaacaccttttcgtggatctcgaatctcagccgcccattttccccatggacgcttacgtatccctctataaacattcttcctcttcctccgtttccccggctctgttgcctgctccttcttcactgcctcctctttcacgttaacttggttggtgggatggagtttggaggtggaatagaaaccccagaagtcgtcggcggcggaagcatcgagctctgaccagagttcctcagccgtgagtttacggcccttggccttggtgacgagaggggcataatc

SEQ ID NO: 323 - DNA, 663 bp, Arabidopsis thaliana
cgcgcaggagctcttctttcctatgacccaaacctcagggagcctctgtggccatcaaaagaagaagccaaaacacagatcatgagcatttgggacaaagctgagatcatcaaggtgagcgatgttgagcttgagtttctaactggaagcaacaagattgatgatgagaccgcgttgaccttgtggcatcccaacttgaagctgttgttagtcactcttggtgaaaagggctgtcggtattacaccaagactttcaaaggagccgttgaccctttccatgtgaacgctgtggacacaaccggagctggagattcctttgtcggtgctcttctaaaccagattgtcgatgatcgatccgttctcgaggacgaagagagattgaggaaagtgctgagattcgcaaatgcttgtggagcaatcacaacgaccaaaaaaggagccattccagctcttccctcagatgctgaagttcggagctttctcgaaaagaaatagaaacaaaacaactcaagcttctattacgtaatctgtttccgcgattatcttctctttttgtattcttgttttcggatggttgaatcgagaagagaaacaaattcggcattccgctctgtttttgtttctcttcttcaaatgtaatgatttagaaaagacgtatgttgc

SEQ ID NO: 324 - DNA, 588 bp, Arabidopsis thaliana
cgctgaaaatgccggcgggacacggagtgagggcgagaataagagatctgttcgcgagaccattcaggaagaagggttatattccactctccacttacctcagaaccttcaaggtcggcgattacgtcgatgtcaaggttaatggagctatccacaagggtatgcctcataagttctaccatggtcgtactggtcgcatctggaatgtcactaagcgtgccgttggtgttgaagtcaacaaacagattgggaacagaatcataaggaagaggatacatgtgcgtgtggagcatgtgcaacagtcaaggtgtgctgaggagtttaaactcagaaagaagcagaacgatgtgcttaaggctgatgctaaagccagaggagagactatcagcaccaagagacagcctaaaggtcctaaaccgggtttcatggtcgaaggtatgacattggagactgtcactcccattccttacgatgttgtcaacgatctcaagggtggttattgagttttttccattttattatcattctctactcagaatttttgcacttgcttttttaatgatgtttttgtatcaattaagactaatt

SEQ ID NO: 325 - DNA, 688 bp, Arabidopsis thaliana
tttcttcctgtgcgaccctcgaatcccaattcaaagtcctttcgcttaagggaatctcttgttcgtcaccatcttcttccttctccaatcgtcgtggtgcttcggctaccttatcctcttcccttagcttctctcagagcgtttctcaatgcgtcgccttctcaaccgggaatttgtgggtacagaagccaatgaggcaattgattgtgtgtgaggctgctgctcctaccaagaaagctgattcagctgcaaagagagctcgccaagctgagaagaggcgtgtttacaacaaatctaagaaatctgaagcccgtacccggatgaagaaggtcttggaagcacttgaggggctcaagaagaaaactgatgcgcaagctgatgagattgtgacggtggagaaactgataggagaggcttattctgcaattgacaaagcagtgaaggttaaagcactacacaagaacactggtgcccgtaggaagtctcgattggctaggaggaaaaaagccgttgaaattcaccatggttggtacgtcccagacgcagctgctgcagcaccatcagaagctgtgcccatggctgcataagaacatggggataacggaaatttgtttttgttactagatctttcaaaatcaaaatctgtttctttataatgtacatttagtcgctttcagactcttcgctt

SEQ ID NO: 326 - DNA, 612 bp, Arabidopsis thaliana
cgcggaaacttccctcttaaccaacagtctgctactaccggtacaacgcttggttatgacgatgttcttagttctcaatacaaagagaatcatctgttggcacttcagcagcagcagcaacaacagcaacatcaacaacagaacgaaaactcggcgatgtggcatcagggtcatggttccagaaccatgtcaggtgtcccgactaacacgtattacaacctccaagcacaacaacaactgcaactacaacaccagcaacaacaacagcaggctcagcaagcagcgggagggtatcgccaagctcagcaacaacagcattatggatctcatggatacccaaattattatcagtctcagaccgaaatgtcactcgagcgccagcagcaaaaccctagggatggtgctgggtctcaggctggtcaaccgtcgaatcaatctcagcagcagctctggcaaaactcttactaaataaagaaagagagtggtttttttcagcttctttctctcgcttatagaggtttgtgtggcgagtctgaagaggaaatatggttgtgttctaaaatgtaacttatcatcatcttttgtctcctctgttaacttagggaacatgca

SEQ ID NO: 327 - DNA, 794 bp, Arabidopsis thaliana
ctcagttcgtgttcttgtcattaatgcggccgctaataaagtactcgtagtacaactaaaaatcttacacaacaagctccaactgtcaaaacctcaaaaattgaaaaacttcatcaaagtctcctaacgagtctacttaacgaggaggagagacaggcacattagctttcgcgaaactgatccaagcaacaacaccaatggctagaatcacccaacccatagcatcatacttggcatcactacttttcttattcttcactgcctttgagctcggcggtgctggagcttcaacgcgacccattggttgtgagcctaagccttgtttgtaagcttctgcgtgcagctgtggagccttggccgtcatttcgagtgatttcaggtagtgtgtattatctggttgctcatccacagcttgttgaaagaactgagtagctaagtcaaagttatgtttagcttcagtctcgtcaggagtcagaaacgcaaatgaagtgtatgcattcccaatacaccaaaccgcttcatctttctttgggtcaatcaacaatgcctcttcaaactttgtgatggcctcttgaatcatttgctttgcatctgagatgctatgaaactgagataactcgagtaaaactcctccccatctagtcagattatcggcatctaaaggatttgacttgtaggtattttcggcgtcttgacgaatttgttcgaacaatagtatcctatcgaactcagtgcggccgctcgaggggtagtcaagatgcataataaataacggattgtgtccgtaatcacac

SEQ ID NO: 328 - DNA, 514 bp, Arabidopsis thaliana
cgcttttctcaagttccattaatactcgatagtatatgatctcaagaaaaaaaatgttttacttcgtctcaagataaaatcaaaaccaacagagagtctagaataaaagtgaatagataaaactacagctcctgagaaatgataatggcgattccttccgatacttgttgaaatctagcctcctcatatgttgctagggtacatgaagactctgactctagctcccattgacttgggtggtaggtttgaagtgaacttagaacggacaacaccactgttaccatgaggcctagtgactttgccccaaatgcaacggtagtgagaaccgttcttctttgtctttgccttgtagatgtaagccaaacgcttacccttgtaccaattaacctcctcttgagtgttcacaccttcaatctggacgagagaagtgttagggtattggttcgacttggacctcttgtaaccgaggactgttccacgaacatacaatctaactctctctccttgacgtccc

SEQ ID NO: 329 - DNA, 801 bp, Arabidopsis thaliana
cgcgcttctcagccagtggaatcatctgaaaatgggtttacttctgaatctccgaaagagagttctttgaagcaagaagcagctgttgtctcttcaccaaaagcttctcagaaagttgttgctagtacgtttaagaaacctcttgtttcgcgaaagtctgggaagactggtggtcttggtgctcgtaagcttactactaagtcaaaggataacctctatgagcagaagcctgaagaacctgtacctgtgattcctgctgcttctccaaccaatgacacatcagcagctggatcatcatttgcctctcgatttgagtactttgatgatgagcaatctggtgggcaaagtggcacacgggtgcttagccatgttgctccaccaaagtcatcaaatttctttaatgaatttggaatggacagtgctttccccaagaagtcaagctcaagctcatccaaagctcaggttgaagaaacagatgaagcaagaaagaagttttcaaacgccaaatcgatttcctctgcccaatttttcggaaatcagaacagagatgccgatcttgactcaaaagctacccttcagaagttctcgggttcagcagctatttcaagttctgatctttttggccacggaccagatgattccaacatcgatatcactgcaagcgatctcatcaaccgaatttctttccaggcgcagcaagatatgtcatctattgctaacttagctgaggaaacaaagaataagctgggaacatttgcctctagtatattcagtgatcttcaggatagaatgctgtaagaa

SEQ ID NO: 330 - DNA, 745 bp, Arabidopsis thaliana
cgctttttgcggaataaataacttgagaatcttccaacacagaaaacaagaagagagaaaagtaaactggcaggtaattttaataggggacgacgacgaaacacaggacaatataaagaaacataaacttagagagtcgctgcgaccgaccacagtaacccaacgagagcttctctctcagcacttgacctccttcaaaccatgagcgaagtacaaaaatgttgggttagttgaaccctccttgtagtaagcaaagaccaaagtgctgtcatcatgcataccctccccaacaaagaattggaagtcactgagcctggggagcaaaaacttggtagctccctcaatacccttcttgaagacagcttgatcttcttcgctgagcttgggtgtcaaaagcttaatgtatttcttaatgtaagcgatgaatcccttcttgtcataagttggttgctcctgaagtctgaaggtgtcgacaatgtcaacaaccttttgagtagagtcatcaacaccttcatcctcaccaccttcttcagcagatggattggcaccaatgttaacatctacagctcccacagtaacccactttccttctacttcccagaggattccattctcaatctccttgtaagggaaagagtcagacagaagctcatcaccggtgagaagatcttggtacaccaacatggtcgcttattgattgttttctctctccgatggatgcgaataaacgaaaatcgaaggttgc

SEQ ID NO: 331 - DNA, 596 bp, Arabidopsis thaliana
cgcgaaaaacaaatgtatgactcaatgtgtgatagaaacagcgatttgaaaagagaatataagaaaaatacgtgagatcaaccgaggagagaaaagccctgtccaattagggcagtggcaagaatctcattggcagcttcagaaggatgcacactgtcccagaacacatactgagtagcattggagcatgtcccaaacgatttcgggttgcacaagagtgaagttgtctcgactgttcctgttccacaacatcctttggttgcttccgtgaatccggatttggaagggttctgaacaagatcataaagtggagagtagatgtcgaagacaacaatcttaagatcggaatattgcttctgaagctttgaagcagcagcgttaagcttcttgttaaagttttgagcatctgtgttgagtcttgaaacacagcctttttcatggaaaccgaaaagggttcttgcagcgggaagacatcctgttggaggcagagatgtcacaccgatcttccttgctccaaccgcatacacttgcttgataaatgtagagaagttatcgataaggaaagatccgtatgcatcaacagtgtaaactttgta

SEQ ID NO: 332 - DNA, 572 bp, Arabidopsis thaliana
aaaaacaatggttgcatttgaagtacattaatggtctttgaacaccaaaaagaacattacaaaaaacgaatacgaaaagcagcaaacagttgagtcacttagacattcttgtttttcttcatcttggaaggtggccatcgacccttcttcctcatcttacgcttacgaaccagacgtttcctgcgtagcctaatctttttggccagcttcatcttcagcctcaattccaagagcagtttctctttagcttctttcgattccaacggtagtttatccactggaacagcagcaacaacagtctttggttcctccttgctctcaggctcagccccgtccacgccagaagcagccgccttcaccacaattcttccatggctagagttcaagctgtaagcactgagagagactctgttcttggactcgacagcgttgggtttaaggctcaaaacttggagaagcgaaagacggagattgaagaagcgcgaggaagaagaagaagaaagagaagagagagaagggagagaattgaagcagagaagagccatcttcttcttctaatggaagaatttgtc

SEQ ID NO: 333 - DNA, 891 bp, Artificial Sequence
  Synthetic
tttttttttttttttttttttttttttttttttttttttttttttttttttttttttttttttttttttttttttttttttttgctgaaattcaagcatttagcattacacgaatgatcatgggagttttacattgtctttctaatttgtttctcttctcaaaccgaaaacctatcttgacctgaagtacaaaaaacaaaaacaaaaaagaaagtgaaagtctttgtgtcttgttgcactttatttcgagatatgagacaatgttgtgaatagccttgtttccaaatcaagtttcagacaaaaccccctcagagagaatggtccgatcttaaatctcttagaagaatgacttggccgcatcaacaacagcttcaacggtgataccaaactccttgtagagtaagggtgctggtgcgctggctccgaatgaattaataccaatggactttcctttgcctccaacaatctttccccatccgaaagtcgaagctgcttcaatgctaactctagctgatacatccgatggcaacacactctccttgtattcatctgattgctcgtcaaatagttcccagcacacgaaagaaacaactctaacggttttgccgtctttcctgagcacctccgcagccggtgcatacaagatcgctgtcaccaagcgcaagacaccatctatcttagctctgtctaggcaaaagctgcctcatcttccaggtacatccatcgaaggagtggaaaagggtgatatacaatttctgacgactcttcaggcaacaaacccgatgtgatcttgattggaactggttctgagctagagattgctgcacggacgcgtgggtcgaggggtagtcaagatgcataataaataacggattgtgtccgtaatcacac

SEQ ID NO: 334 - DNA, 2594 bp, Nicotiana benthamiana
ttgaaaatgagatcttggtatcaatcgccaaataaaattacaaaactcgaagatatgttttatgtgtacatggtcaggagcatccataatcctatttctatcctcatcttggattcattttggtggccactccgctactaaaactgaagaaaacaaaggacagatgaagaaatagtttttattgaaaatatcaggctacagtgaactgccgagttcgtttggtattggtttccaccattatctccaatctcagtttcaatataaaaacaaatttggtagacaccagtaaccaagggtaagtaataagcctaagaaacttgttttgctgcagctataacagcctctgctgtaattccgtactccttgtatattattccagcaggggcactggcaccccatctatcaattccgatggccttcccctttgatccgacatatttctcccacccaaatgtggatccagcttcaatgctaactctagctgtaacggatgatggaaggacactttccttgtagtcggctgattgttcttcgaaaagctcccaacaaacaaaggaaacaactctcactgcctttccttctttcctgagttcatcagcagccttggcagcaatttctaactctgagccagtaccaatcaaaatgacatcaggtttgttgccagaagaattgtctgataaaatgtagcaaccctttgctgctccttcaatagagcttccagcaagttgaggtaacttttgtcgagagagtgcaaggattgatggtgtcttcctcttgaggacagccaccttgtaagctcctgctgtctcattgccatctgctggacggaacatcagaatgttgggcattgcacggaaacttgccaagtgctcaatgggttgatgggtaggcccatcttctcctagaccgattgaatcgtgggtcataacataaataactccagcctcagacaaggctgaaattctcattgctcctctcatgtagtcagtgaacacaaagaaagtagcacagtagggaatcaagccagggctgtgtagagcaatcccattacatatagctcccataccatgttcacgaacaccaaaccttagattacgctcctctggggtgttcttttggaagtcaccaaacattttcatgagagtcatgtttgatgaggcgagatcagcactaccaccaaggaaaccagggagaaccttggcaagagcattcaggttttgttgggacaagtttctggtggcatccgctggactttcaggtgtgtaggtaggcagagctttctcccagccagcagttagttcaccagtggtaatggatttgagttctgcagcttcctcggggtacttcttctcatattcagcaaacttggtattccatccaacttcaagagcagcaccctcgggaacatgacgactccaatggctcttgacatcttcaggcacgtggaacggctcataaggccatcccaagttactcctggtggcctctacttccttagctccaagtgcacttccatgtacactgtaactgtttgccttgttgggcgagccaaaaccaatggttgtagtcaccttgatcatagtgggtttgtctgtgacagcttttgcttccttaatagcagcacgaatctcatcataaccagtgttaccgttcttcacccagattacgtgccacccaagagcctcaaaacgggcaccaacatcctcagtgaaagcgatttctgtgtcaccatcaattgagatgtggttgtcatcatagaaagcaatcagctttccaagtccccagtgtccagcaagtgaacaagcttcttgtgaaataccctccatctggcaaccatcaccgagaataacatatgtgtagtggtctacaatctcagcgtcaggcttattgaagcgagcagccaagtgtttctctgcaagggccaagccaacggcgttggcaataccttgtcccagaggcccggtggtgacttcaacaccaggtgtctcaaagttttcagggtgtccaggggttttgcttccccactgacggaagctcttcaagtcctcttccttgacagcatcatagccagctagatgaagcaaagcatactgaagcatacaaccatgtccagctgatagaacaaaccgatcccgattaaaccaatacggatttttcgggttatacctcataacctcatcgtacagtatatgacccatcggagcacaacccatgggcaaaccggggtgacccgaatttgccttttcaacagcatcaatagccaaaaatcgaatagtgtttacagatttgtcaacaagggcagtctcagttttctgtatagtttcggttgcagccgatgcacgaatcgtcgatgaccgtacggcggcggcggagggaggagtacggcggcgggaggtggtgatattggggttagatttaaggccggaaaaagtgagagaagaaggggaaagttgagaagaagaggcagagccatggcgagggactgaacgagagaggatagcttgagagagagtgagagaagaagaagaagcccggacgcgtgggtcgaggggtagtcaagatgcataataaataacggattgtgtccgtaatca

SEQ ID NO: 335 - DNA, 1569 bp, Oryza sativa
cgttttaaatagatcttacagtatcactactccatctcagttcgtgttcttgtcattaattaactcgacccacgcgtccgcgatggtacgcatcatcggcccaagtccagctcaatcctcctcaccaacaccaagacgaccacgacctcctcgccctcgccgccgcccaccgaccatggcctccgccgccgcttcttcctccaaacctcccgtcgtgcttggctgcggcgccgtctccgcggactacctcgccaccgtcgcctccttccccaaccccgacgacaagatccgaagcctaacgctcaaggtccagggaggcggcaacactggcaatgccttgaccgccgctgctcgtttgggccttcgcccaaggatcatatccaaggtatccaatgacccacaaggaagaaatattctcaaggagctgcaagatgatggggtcgacacctctcatatcctggttgcagaggaggggaattcacctttcacctatataattgttgacaaccagacgaaaactcgtacttgtattcacactcctggttatcctcctatggtccctgaagagctcacacaagaaaacttgtttgccgctttagacggtgctgacattgtatattttgatgtcagattgcatgaaactgctttactagttgctgaagaggcaagccaaagaaaacttcctattttgattgatgccgaacggaagagggatggattggacgagcttctcaatttcgcatcttatgttgtatgctctgcaaaatttcctcaggcttggacaggagcctcatcaacaccggttgctttggtgtccatgcttttaagattgcctaatatcaagtttattattgtaacccttggagaaaagggatgcttgatgcttgaaagaagcacaacagatgcttctgaggcagaggaaatagatgtagagagtcttctggaatcactagagaagaaagaagttttgagttcaagcatgccaaaatgcatcgcctccaagtcaaatttgagaataagtgcagatggaataggatccatcagtggcagattacttttaggcactgccgaaattataccctctgaagagctcatagatacaactggtgcgggtgatgcatttatcggagcagttctctacggtttatgctctggcatgccgcctgagaagatgctgccttttgcagctcaagtggctgcttgcgggtgcaggggtttaggggctcggactgctcttccccatcgcacagatccccgcctggttgcctattgactcgaggaactgtagtgtatcaatctgtgttggatctgattgggatggattcattggattgtgggcgcctttgaaaaataagagattaagcatttgaaatatggagtaataagaaagccgcctgcagttgaaatcggttcctaagttgtatgtaaacagtgattgttgttgcatactgtcaatataccttggcttgtgttaataagagagatttgtgtgctgttgttgcaaggcccaaaaaaaaaaaaaaagggcggccgcgtcgaggggtagtcaagatgcataataaataacgg

SEQ ID NO: 336 - DNA, 629 bp, Oryza sativa
cgatcgcttctcatcgcaaatcgcatcgacttcgattcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtctccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcatcctctgctcctacgacccc

SEQ ID NO: 337 - DNA, 700 bp, Arabidopsis thaliana
cagaataagtaaatccatgggagaaaacgcctagcttgctgctatgagaatttatgacatctgccacttcttggctcataagaatggctccaatcggcatatatgctgaagacagtgccttagctaaggtcacaagatctggcttaatgttgtatttgtcacagccaaacattgtcccgagccttccaaatgcacatatcacctcatcagcaatgaacaagatatcatatttcttaacaacagcttgaaccttttcaaagtaggtagcaggtggaggtatcacacccccagcacccatgactggttcagctataaaagcaccaatagtttctggtccttctttgatgattagatcctctaaattcttggctaatctggttgagaactcctcttccgtttcgcctggaagatgaaaacgccaataatgagggcaatctgtgtgcaacacaaatggtgcaggtaaatcaaaattttggtgtagcgggggaaggccggacaaacttgctgatattagagtggagccatggtacgatttctttctcgcgataaactttttcttctcgggccttccaagtgcgttattgtaataccaaaccagcttgacctgggtatcgttggcatctgatccaccgcttgtaaaaaatgctttggccattttgttggccgtgaacatctctaaaagaaccttagcaagatccag

SEQ ID NO: 338 - DNA, 639 bp, Arabidopsis thaliana
ccttctcttctctaaataaaaaaaaaaaaaactgttttttgtgaaaattaattgaccaaaaacaaagaaatcttctttcttctcttctcttctttgttaatcttgttacccttctaccaccaccacctgtaaaaaagaggtttttatctaccacatagagagaccagacaagaacatgtgattctttggttaggtctctcaattctgctgagccacaagctgatcgagctgcatttgctcaatccaagcttctagcccagcatgatccattaccggttcaaccggatttggctgcttcatcacgtgttcccctgaggaagatgttgctgctttctctttggcttctgctggagtctccttcaccagtgactggacccatgacacatcaggctcatcaccatcaaacgatgacgaagatctcaacttaccaagtgcttctgagctcattccccaatccggttgaccatttgaagatccccattttgatgaccatgtgttgttgtttaccggtgaaccaacgattgggctagagtttgttctgagctctctggagctaaggctacggaactgatgttgctgctgctgctgctgctgttgctgttgttgttgcttcacgcactgagccaacatggaaacccg

SEQ ID NO: 339 - DNA, 191 bp, Arabidopsis thaliana
ggaagaaaaaacgtctcaaatgtaaccgataaacctaatatacctaaaattacttaaaagggtttgcagtattgaaaaatgttgatgagttttaaaaggaaaaaaaaaaaggtaacctgaatatagatcaaaacttgccccgaggacccaacttaagcggctcctgaggaccttttttgatgggaaaaact

SEQ ID NO: 340 - DNA, 646 bp, Oryza sativa
ctcacccagggcgacgccaacgacgagaagaacgtgctctcgctctggttcgacggcctcaagctcctcatcgtcaccgacggcgagaagggatgcaggtacttcaccaaggacttcaagggctccgtccccggcttctccgtcaacaccgtcgacaccaccggcgccggcgacgccttcgtcggctccctcctcgtcaacgtcgccaaggacgactccatcttccacaacgaggagaagctgagggaggcgctcaagttctcgaacgcgtgcggagccatctgcaccaccaagaagggtgccatcccggcgctgcccaccgtcgccgtcgcgcaggagctcatcagcaaggcagccaactagagctcctcggtttcgtcgtcgatcgccgccattgggggcctcggaattttaggtcgatttaatttagttgctgcttcgttttagacaaggaagaggaggggcttgggtgtgttcatgtctgtcttttgtgtgctaagttagttgcttccgtgtgagaacttttggcgtttatttttactattattattaataagaagctcttggatttgcggtggatattttggtctgaatttgtgtaatgaggcagctacttggcgaaatttattgtgtcatgtctttgttc

SEQ ID NO: 341 - DNA, 528 bp, Arabidopsis thaliana
gttgtcccattattgtttattcctcattaaaatgtacttatttaaagacttgttgtgtgttaaaaaaaaaaacaaaggatccaaactttgaaaatctaaaaaacatttttcatcaacatcattttgactctgcttttcacttcttgtgctgagccttgatttcttttaccttctcttccgttgccttcaatgctttcccataaataaaaatcaactcatcaatctcttcaggtgaaataatgagcgggggaaacatcaaaatgccatcacctgcaacacggactaacatcccgtgcttctggcactcggttccaaaaaatgcgccaacaccccattctggtggaaatggttcgttcggaaatttattgtctacaaactcagtcccaaaaatcaaacctgttcctcttgtctctccaataataggactaccagaggcaaacgctttaactccatcttgaaaccttggggcaactttggcgacataatctggtatgttcctctccttgtatatctttaacgcttcaattg

SEQ ID NO: 342 - DNA, 191 bp, Arabidopsis thaliana
ttaacaaatagtcataacaataaaatatataaaaaataataatattaataacaataataataatgataatgggagaaagaaatccctaaaaaaaaattgaaaatgggagaaagaaaaccaagaaggttttgtttcatctcctttcttcccataagcctttttcttgtattgttcccttctcttctctaaat

SEQ ID NO: 343 - DNA, 612 bp, Arabidopsis thaliana
cggtagaggtagcgctgacataagtaagcaaagagcctcctccaaggatcaagaacttgaggagcaatcctctctttgtgaatggggcagcgaatgtctcaaagaccttgctctgaagaggattgtaaggagaaggagcatcagagccgtatacgtcccattgacctgttgtgttacccaaatcttctaagtcaaagtagacacttttgtctccatacttagccaccacaccattagccctattacacatgaacacaccaccctcaagctaatttaatcccaaccaagagatgaaattatcagaatttaatccttttaaagctaattaatcatcactatatctatcgtttaaaacacacttcagccagcaaaaatctattaatatattttgaatttatagtgtggttatagtggcattttgatcctaattaatgaataaatgaaaagttttagttaccggatggatttgggtttaaagctcaggcgggaaggcttgatggagagcttagctccggcgagtgagctgccgccgagtccttttatggcggcggatggtttcacagcggcgacggttgcaagccccgccatgagcttcgatcactattcttttgt

SEQ ID NO: 344 - DNA, 542 bp, Artificial Sequence
  Synthetic
tttacgctttacgacagttccatcgatcaacaccgcaaagatgggctacgacaagaccgaccagctggccatcaacaccatccgcactctcgccgttgatgccaccttcgccgccaactccggccaccccggtgcgcctatgggcatggccccggtctctcacgtcctcttcaacaagttcatgaagttcaatcccaagaaccccaagtggctgaaccgtgaccgcttcgtcctctccaacggccacggctgtgtgctccagtactctctgctgcacctgttcggctacaagctctccatcgacgacctcaagaacttccgccaggtcgaatccatcaaccccggtcaccccgagtcccacgacaccgagggcattgaggtcaccactggtcccctcggccagggtttcgccaacgccgttggtctcgccattggtgagcgccagaacgccgctaccttcaacaagcccggctacgagcttgtcaacaactacacctactggttcttcggtgatggctgcgccatggagggtatcgcctccg

SEQ ID NO: 345 - DNA, 136 bp, Artificial Sequence
  Synthetic
gaagaaatagtttttattgaaaatatcatgctacagtgaactgccgagttcgtttggtattggtttccaccattatctccaatctcagtttcaatataaaaacaaatttggtagacaccagtaaccaagggtaagt

SEQ ID NO: 346 - DNA, 572 bp, Artificial Sequence
  Synthetic
  misc_feature (417)..(417): N at this position can be a, c, t, or g.
ccaattgaaaataagatcttggtatcactcgaccaaatgaaattacaaaactcaaagatatggtttaaagtgtacatggtcaggagcatccataatcctatttctatcctcatcttggattcattttggccgctccgctactaaaactgaagaaaacaaagggcagatgaagaaatagtttttattgaaaataccaggcaacagtgaactgccgagtccgtttggtattggtttccaccatcacctccaacctcagtgtcaaactgaaaacaaatttggtagacaccagcaaccaagtgtaagtaataaagcctaagaaacttgtttagctgcagctacaacagcctctgctgtaattccgtactcctggtatatttttccagcaggggcactggcaccccatctatcaattccgantggccttccccttntgatccgacatatttctcccacccaaatgtggatccagcttcaatgctaactctagctgtaacagatgatggaaggacactttccttgtagtcggctgattgttcttcgaaaagcctccaacaaacaaaggaaacaacggg

SEQ ID NO: 347 - DNA, 2608 bp, Artificial Sequence
  Synthetic
  misc_feature (726)..(726): N at this position can be a, c, t, or g.
gaattcagaagaagaacagaggagaaggaaaaaaaaaaatcaatcctttattccgataatagcctcaatcatggcagcatcttcatcccttacagtatcacaagccctagttggcaggaaaatctctggtattaacacttcttctcgttcacaatcattacctggattcagtctaagtactttatcaggaagaacattgaaatcttcattgatttcatcgattgcatcatcacgatctaatcgtgtcaatacaccatcgttatcgagatcgttggtggttcgtgcttcagctgttgagactttggaaaagacagatacagcattagttgataaatcagtgaatactattagatttctagcaattgatgctgtcgagaaagctaattcaggtcatcctggtttacctatgggatgtgcgcccatgggtcatattttatacgatgaaaccatgagatataaccctaagaacccttactggtttaacagagatagattcgttctttctgctggtcacggttgtatgttgcagtatgctttgcttcatcttgctggttacgacagtgttacgacagaagatttgaagactttccgtcagtggggaagcaaaattcctggtcaccccgagaacttcgagactcctggtgttgaagtcactacaggtccccttggacaaggtattgctaatgctgttggattggcacttgccgagaagcacttggctgcccngtttcaacaagcctgacagcgagattgtagaccattacacatactgtattcttggagatggatgtcaaatggagggaattgcaaatgaagcttgttcgctagctggacattggggacttggaaagctgattgctttctacgatgacaaccacatctctattgatggtgacacagagattgctttcacagagagtgtagatacccgttttgaaggtctaggatggcacgtaatttgggtgaagaatggtaacaatggttatgatgaaattcgtgctgccatcaaggaagcaaagtctgtcacagacaagcccactttgatcaaggtgactaccaccattggttttggttctccaaacaaggcaaactcatacgccgtacacggtgctgcattgggttctaaagaggttgatgccacaaggaagaaccttgactggccatttgagcctttccacgtgccagaggatgttaagagccattggagccgccatactgctgaaggtgctgccctagaagctgaatggacagctaaatttgcagagtacgaaaagaagtactcagaggatgctgcagaatttaagtccatcattactggtgaattccctgctggttgggagaaggctcttcctacctacactccggagatcccagctgatgccaccagaaacctatcccagacatgccttaatgcacttgctccagtcctccctggtcttattggtggtagtgcagatctcgcttcctccaacatgaccttgatgaaaatgttcggagatttccaaaaggccactccagaagagaggaatgttcgatttggtgtcagagagcatgctatgggagccatctgtaacggaattgctctccacagtcctggttttgtcccctactgtgctaccttctttgttttcaccgattacatgagaggtgccatgagaatttcagctttatctgaagctggagtcatttacgtcatgacccacgactctattggtcttggagaggatggtccaactcatcagcccatcgaacatttggcaagctttagagccatgcctaacattcttatgttccgtcccgctgacggaaacgagactgccggggcatacaaggttgcagttgaaaacagaaagagaccctcaattcttgccctttcacgtcaaaagcttgcaaaccttccaggaacctccattgaaggagtcgccaagggaggttacacaatatcagacaactctacaggtaacaaaccagatgtcatcgtgtgtgctactggttcagaattagaaattgctgaaaaggccgctggtgagcccaggaaggaaggaactgcagttagggttgtttcatttgtttcctgggaattatatgatgaacagaccgacgaatacaaggagtctgttcttccagctgctgtcactgctagagttagtattgaggcaggttcaacattcggatggcacaagattatcggaagcaaaggaaaggctattggtgttgacggtttcggagcaagtgcgcctgcaccaattatatacaaagagtttggcatcacatcagaggccgttattgcagcagctaagtcagttatgtagattgttttctttgtccctttttcagctgaagcttatttgtcattttggtttttggatttctgctcttccaaatttagaagtgacacgggaggagagaggcctgtctttaagagtaatttgagttcagaaaaacagcctcgtgaacgaattataataataattaaaaaaaagaacaaaaaagcttccttgtttcatatcttcacattaactggtgaatcagagttgtcttattgaaattcatgagaaacaaaataatgtattgtctttcacagtttctcttaaagcaaaaaaaaaaa

SEQ ID NO: 348 - DNA, 700 bp, Artificial Sequence
  Synthetic
gagccgcagctcgtcctctccatccccacaccgatctacgatgccagtgccggttgctgctcgatcgatcgcctctgggacctcagcggcacagcaatctccatctccggcttcgatgctctgcccagcgaagcgatcaggtgagcgaatccatccggcagtcgacagctctagatttcgaggcgggggagacgcgcgatcgatccgtggatgcggcgaggcagcaatccagggaagaaccggagctagggcttgtcgaggcatgggaggaggagctgaggatgatgcttggatccaaggcctgggagaatgctaaggccaatgaagattcccgcgacaaggaatggctacaggagcagatcgatcggcgatgcgtggaaaatattcgcatgcttgtggtggatgccgtcaacaatgcccgggctgggcatccagggctgccgctgggaatggccgaggttggattcatgctgtatagcaaggtgatgaagtacaacccggcgaatcctggatggtttaaccgcgaccgattcgttcttagcgctggccatggttgtcttcttcagtatatatgtcttcatctagctggcttccaatctgtccaggtggaagacttgaaacggctgtgcaagcttggaggacgaactccaggtcatccagagaatgtcatcactgcgggagttgaggtctcaactggtcc

SEQ ID NO: 349 - DNA, 309 bp, Artificial Sequence
  Synthetic
gccaaatcaggtcatcctggtcttcctatgggttgtgctccgatggctcacattttgtatgatgaggtcatgaggtataaccccaagaacccttattggttcaaccgtgaccgattcgttctatctgctggacatggatgtatgttgctctacgcgttgcttcatcttgccggctacgacagcgtccaggaggaagatttgaagcagttccgtcaatggggaagcaagacaccaggacatcctgagaatttcgagactcctggaattgaagtcactactggtcctcttggacaaggaatcgctaatgct

SEQ ID NO: 350 - DNA, 1714 bp, Artificial Sequence
  Synthetic
  misc_feature (658)..(658): N at this position can be a, c, t, or g.
  misc_feature (1085)..(1085): N at this position can be a, c, t, or g.
  misc_feature (1175)..(1175): N at this position can be a, c, t, or g.
  misc_feature (1433)..(1433): N at this position can be a, c, t, or g.
gtaaagcctggcttcttcttcttctctcactctctctcaagctatcctctctcgttcagtccctcgccatggctctgcctcttcttctcaactttccccttcttctctcactttttccggccttaaatctaaccccaatatcaccacctcccgccgccgtactcctccctccgccgccgccgtacggtcatcgacgattcgtgcatcggctgcaaccgaaactatagagaaaactgagactgcccttgttgacaaatctgtaaacactattcgatttttggctattgatgctgttgaaaaggcaaattcgggtcaccccggtttgcccatgggttgtgctccgatgggtcatatactgtacgatgaggttatgaggtataacccgaaaaatccgtattggtttaatcgggatcggtttgttctatcagctggacatggttgtatgcttcagtatgctttgcttcatctagctggctatgatgctgtcaaggaagaggacttgaagagcttccgtcagtggggaagcaaaacccctggacaccctgaaaactttgagacacctggtgttgaagtcaccaccgggcctctgggacaaggtattgccaacgccgttggcttggcccttgcagagaaacacttggctgctcgcttcaataangcctgacgctgagattgtagaccactacacatatgttattctcggtgatggttgccagatggagggtatttcacaagaagcttgttcacttgctggacactggggacttggaaagctgattgctttctatgatgacaaccacatctcaattgatggtgacacagaaatcgctttcactgaggatgttggtgcccgttttgaggctcttgggtggcacgtaatctgggtgaagaacggtaacactggttatgatgagattcgtgctgctattaaggaagcaaaagctgtcacagacaaacccactatgatcaaggtgactacaaccattggttttggctcgcccaacaaggcaaacagttacagtgtacatggaagtgcacttggagctaaggaagtagaggccaccaggagtaacttgggatggccnttatgagcctttccacgtgcctgaagatgtcaagagccattggagtcgtcatgttcccgagggtgctgctcttgaagttggatggaatanccaagtttgctgaatatgagaagaagtacccagaggaagctgcagaactcaaatccattaccactggtgaactacctgctggctgggagaaagctctgcctacctacacacctgaaagtccagcagatgccaccagaaacctgtcccaacaaaacctgaatgctcttgccaaggttctccctggtttccttggtggtagtgctgatcttgcctcatcaaacatgactctcttgaaaatgtttggtgacttccaaaagnaacaccccagaggagcgtaatctgaggtttggtgttcgtgaacatggtatgggagctatatgtaatgggattgctctacacagccaaggcttgattccctactgtgctactttctttgtgttcactgactacatgagaggagccatgagaatttcagccttgtctgaggctggagttatttatgttatgacccacgattcaattggtctaggagaagatgggcctacccatcaacccattgagcacttggcaagtttccgtgcaatgcccaacattctgat

SEQ ID NO: 351 - DNA, 562 bp, Artificial Sequence
  Synthetic
gaggtttcggccatggcgtctctccagtgcaatgccgggcgactcgccgcgacgacgccatcgctgcccgaccgcgccgtctccaatgcccggttcttcgccgcatacacaggtctgcgccacgcttcgcaatccctcgcgaattccccctcctcctcgccacagattcacacgatcaagcggcggatccacagatccggcatggcgtcggccacggcggtggtggagacggcccagcagaccgacaccgcgctgatcgatctgtcggtgaatacgatccggttcctggccgtggatgcggtggagaaggcgaattctggccacccggggctgcccatgggatgtgccccaatgtctcacattctcttcgacgagatcatgaagtttaatcccaaaaacccctactggttcaacagggatagattcgttctttcggctggccatggatgcatgctccagtatgctcttctccacctcgctggatatgatagcgtcaaggatgaggatttgaggaactttcggcaatggggaagcaaaacccctggtcatccagagaattttg

SEQ ID NO: 352 - DNA, 626 bp, Artificial Sequence
  Synthetic
  misc_feature (572)..(572): N at this position can be a, c, t, or g.
ccgcccacgcgtccgtacctctcttgaaaaacaggagagagaaaggctagtagtagtagtttaagaccagggaagagtaaggcaggggaagagagagagagtgagagatctgtctacccatggcttcctcaaccctcatcctgcagcacgttgtcgcctgtaaggccgcctcgccctccatgcccgcggttaccgccatcgctgctgcgccccagtcggagctcttcccttcggttgctaagctctcctccgttggacgattggccgcctcccagatccccctccggcgcgcctctagcccttgcccgccccggcgtaggtccctccgcatctctgccactgctgctgtcgaggccgttgaaaccactgataccgccttggttgagaagtcaatcaacaccatccggttccttgccatcgacgctgtcgagaaggccagctctggccaccctggcctccccatgggttgcgcacccatgggccacatcctctatgacgaggtcatgcggtacaacccaaagaacccctactggttcaaccgcgaccgctttgtcctctctgcaggccacggnatgcatgctgcagtacgcccttcttcaccttgcgggatacgacagcgttaagac

SEQ ID NO: 353 - DNA, 635 bp, Artificial Sequence
  Synthetic
gatggtacgcatcatcggcccaagtccagctcaatcctcctcaccaacaccaagacgaccacgacctcctcgccctcgccgccgcccaccgaccatggcctccgccgccgcttcttcctccaaacctcccgtcgtgcttggctgcggcgccgtctccgcggactacctcgccaccgtcgcctccttccccaaccccgacgacaagatccgaagcctaacgctcaaggtccagggaggcggcaacactggcaatgccttgaccgccgctgctcgtttgggccttcgcccaaggatcatatccaaggtatccaatgacccacaaggaagaaatattctcaaggagctgcaagatgatggggtcgacacctctcatatcctggttgcagaggaggggaattcacctttcacctatataattgttgacaaccagacgaaaactcgtacttgtattcacactcctggttatcctcctatggtccctgaagagctcacacaagaaaacttgtttgccgctttagacggtgctgacattgtatattttgatgtcagattgcatgaaactgctttactagttgctgaagaggcaagccaaagaaaacttcctattttgattgatgccgaacggaagagggatg

SEQ ID NO: 354 - DNA, 697 bp, Artificial Sequence
  Synthetic
gggccttgcaacaacagcacacaaatctctcttattaacacaagccaaggtatattgacagtatgcaacaacaatcactgtttacatacaacttaggaaccgatttcaactgcaggcggctttcttattactccatatttcaaatgcttaatctcttatttttcaaaggcgcccacaatccaatgaatccatcccaatcagatccaacacagattgatacactacagttcctcgagtcaataggcaaccaggcggggatctgtgcgatggggaagagcagtccgagcccctaaacccctgcacccgcaagcagccacttgagctgcaaaaggcagcatcttctcaggcggcatgccagagcataaaccgtagagaactgctccgataaatgcatcacccgcaccagttgtatctatgagctcttcagagggtataatttcggcagtgcctaaaagtaatctgccactgatggatcctattccatctgcacttattctcaaatttgacttggaggcgatgcattttggcatgcttgaactcaaaacttctttcttctctagtgattccagaagactctctacatctatttcctctgcctcagaagcatctgttgtgcttctttcaagcatcaagcatcccttttctccaagggttacaataataaacttgatattaggcaatcttaaaagcatggaca

SEQ ID NO: 355 - DNA, 646 bp, Artificial Sequence
  Synthetic
cttttcttctttattgtatagatatatactttacatacacatgattctctctattcatagtcggtatggcagctaacggcgttagttctggtttaattgtgagcttcggcgagatgttgatcgatttcgtgccgacggtctccggtgtatcccttgccgaggctccgggtttcttgaaggctcccggaggtgcaccggcaaacgtcgccatcgcagtgactaggcttgggggaaagtcggcgttcgtcgggaaactcggcgacgatgagttcggccacatgctcgccgagatactcaaaaagaacggcgttcaagcggacgggatcaacttcgacaagggagcgagaacggcattggcattcgtgaccctacgcgccgacggagagcgtgagttcatgttctacaggaatcccagtgctgatatgttgctcactcccgacgagttgaatcttgatgttattagatctgctaaggtgttccactacggttcgataagtttgatagtggagccatgcagatcagcacatttgaaggcaatggaagtggcaaaggaggcaggagcattgctctcttatgacccaaacctccgtttgccgctgtggccgtcggcagaggaggcgaggaagcaaatcaagagcatctggga

SEQ ID NO: 356 - DNA, 614 bp, Artificial Sequence
  Synthetic
taactgatttgaaacagagcacacgaaaagattttcttttcctctgaacaaagacatgacacaataaatttcgccaagtagctgcctcattacacaaattcagaccaaaatatccaccgcaaatccaagagcttcttattaataataatagtaaaaataaacgccaaaagttctcacacggaagcaactaacttagcacacaaaagacagacatgaacacacccaagcccctcctcttccttgtctaaaacgaagcagcaactaaattaaatcgacctaaaattccgaggcccccaatggcggcgatcgacgacgaaaccgaggagctctagttggctgccttgctgatgagctcctgcgcgacggcgacggtgggcagcgccgggatggcacccttcttggtggtgcagatggctccgcacgcgttcgagaacttgagcgcctccctcagcttctcctcgttgtggaagatggagtcgtccttggcgacgttgacgaggagggagccgacgaaggcgtcgccggcgccggtggtgtcgacggtgttgacggagaagccggggacggagcccttgaagtccttggtgaagtacctgcatcccttctcgccgtcg

SEQ ID NO: 357 - DNA, 655 bp, Artificial Sequence
  Synthetic
gatatggcgagggatacgagctccaatctggtggtgtgtttcggcgagatgcttatagactttgttcccacagtcgggggtgtctccctggcggaggctccggcgtttaagaaagctcccggtggagctccggcaaatgttgcggtcgggatctctcgccttgatggaaactccgcattcatcggtaagcttggtgaggatgaattcggcttcatgcttctggacatcctgaaggacaacaatgtagagagcaaaggcatgcgttttgatcccggtgcccgtactgctctcgcgtttgtgacgctccgcaaggacggcgagcgtgagtttatgttttaccgcaatccaagtgccgacatgctgctaaagccggacgaactggacgaagaccttatcaaacaggcctccattttccactacggttccatcagcctcatcgcagagccctgcagatcggcccacttggccgcgatgaaaatcgccagagaagccggggcgatcctttcgtatgatcccaacttgaggcttccattgtggagctcggcagaggcagcccggagcggcatcaaaagcatctggaacgaagccgacatcatcaagataagtgaggaggagatcactttcctgactgaaggaggcgatgcatacagcgatg

SEQ ID NO: 358 - DNA, 614 bp, Artificial Sequence
  Synthetic
cccccgatcgcttctcatcgcaaatcgcatcgacttcgattcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcat

SEQ ID NO: 359 - DNA, 775 bp, Artificial Sequence
  Synthetic
gttgtttccctgttatccttgaccgatccatgaaaagcagcttcaagctatccaagagttcttcttctgataagctcaataaaagcaagagctttatctgttcaccaacatctctatcaacgaagaaaagggagcaggaaaacaatcacctggttgtatgtttcggggagttgttgattgacttcgttcctactgtatctggagtttcacttgcagaagcgcctggatttgagaaagctcctggtggagctccagctaacgttgcagttggtatagcaagattaggaggttcttccgcctttattggcaaggtgggtgcagatgaatttggttatatgttatctgatatattaaaacagaaccatgtcgacaattctggcatgcgtttcgatacccatgcaaggacagcattagcatttgtcactttgagagcagatggcgagagagaattcatgtttttccgcaatccaagtgctgatatgcttcttacaaaggaagagctggacaaagatctcattcagaaggcaagaatatttcactatgggtcaatctctttaatcgcggaaccgtgtaggtcagctcatcttgcagccatggagattgccaaaaaagctggctgcattctctcttatgacccaaatctaaggttgcccttatggccatccgcagatgctgctcgtaaaggcatcttgagcatttgggaccaagccgacgttattaaggtaagcgaagacgaaatcacattcttgacagacggtgaagacgccctacgatg

SEQ ID NO: 360 - DNA, 649 bp, Artificial Sequence
  Synthetic
tccgctctactggaacagaacaactgcttcaattcttccgaaaattagggtttattgtctacaaattccatgttaccagcgattactccaacatttcacatcgtactttcccttttagttgctgaaatctaacgcctgatgtaactgtattagggtctcaatttgaaattcactatctcaactagtttctcagatcaaacactatatccctttctaccattctttaaaacttcatacagatatggctcttcttcattctcctactttctgcttcagtggagtttccacttcaagtcaagcttctagaagtttccctgcccctagaagatgcactgtgaaaccagcaccttttctctcccagtctcttcccttctttcctcgatgcaaacttcaaggaagagcattgccaagcgacaatgggccattagagaaggatgaatcttcccttgttgtatgctttggagaaatgctcattgattttgttccgaccacaagtgggctgtcattagctgaagcacctgcatttaaaaaggctcctggtggtgctccagctaatgttgctgttggcatttcccgtcttggtggttcctcagctttcattgggaaggttggtgaagacgaatttggttacatgcttgctgatattttg

SEQ ID NO: 361 - DNA, 1122 bp, Artificial Sequence
  Synthetic
ccccatgacattgcttaagatgttcggtgacttccaaagggatacgcctgaggagcgcaatgtccgatttggagtcagggagcatggaatgggcgccatttgcaacggcattgctctgcacagcccaggactcattccatactgggctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaagattcaaaccgcgcgttttgagtttttgtcatcgttgatgccaaggaacagtatacatgaagccatgaaggtcttgtgcccaaagcttggaataatgaagggagagggatgcctgcattggagcgtgagtggtattttaggcctgtaataagcactgcttttccatttacgtttgttttgttggatcactccttagatgattcatcaagttgagcctgattcaattggggactggttttggtaatatttacatttgactatagtccagctacaatattccg

SEQ ID NO: 362 - DNA, 599 bp, Artificial Sequence
  Synthetic
gaaacggaatgggagcaatcgcgaacggcattgctcaccacggcagcggactcatcccctactgcgcgacgttcttcgtcttcaccgactacatgcgcggagccatcaggctgtcagcactgagcgaagccggggtcatctacgtcatgactcacgactccatcggcctcggcgaggatggcccgactcaccagccgatcgagcacctcgccagcttcagagcgatgccgaacatcttcatgctgcggcccgccgacggcaacgagaccgccggttcctacaaagttgcagtgctcaacaggacgactccatcgatcctggctctctccaggcaaaagcttccgcagctcgccggctcctcgatcgacagcgtctccaaaggcgcgtacgtcctcagcgacaactcgtcggcaaacaagcccgacctcatcttgatcggcaccgggtccgaggtggagatcgctgtcaaggccgcggacgttctccggaaagaaggcaagtccgtccgggtggtgtcgttcccgtgctgggagctgttcgatcagcaaagcgacgagtacaaggagagcgtcttcccgagcggtgtgactgcccgagtc

SEQ ID NO: 363 - DNA, 723 bp, Artificial Sequence
  Synthetic
agttgaaatctattatctcaggtgaattgcccgttggttgggagaaggcacttcctacatatacaccagactctccgggtgatgccaccagaaacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttcttgacaactcaaccggtaacaaacccgatgtgatcttgatcggaactggatcagagctagagattgctgctcaa

SEQ ID NO: 364 - DNA, 856 bp, Artificial Sequence
  Synthetic
attctacgttataccgatggtttacgaggaattcaagaaaaaggtgaagaaagcagaatgcgaagaagaggaatggaagatcgagtttgcaaagtacgaggagaagttccccgacgaagccaacgaattcaagcaacttaaaagttctcagggatgggaaaaagtcttgccaacatggtcgcaatcagaccctgttgatgctacacggggctactcggagaaatgcctgaacgcgttatctactgcacttcccgcactgatcggtggcagcgcagacttagcatcgtcaaacaaggcctatctcaaagatcacgacgacttccagcataagacaccatggggaagaaacatccgctacggtgttcgggagcacgcaatggccgcgatctccaacggcatttccctccatggcagcggcctcatcccgttcgcggcaacgttcatgacattcagcgactacatgaatcacgcgatgagactgtcggctctcagcgaagccggcgtcatctacatttgcacgcacgactcgatcgggctgggtgaggacggcccgacgcatcaacctgtggaacatctcgcaggacttcgagctattccaaacttatatcttctacgtccggccgacggcaatgaaacaagcggtgcatacaaggtggcggtgaagagacgagatcaaggcccgacggtcatctccttgtcgcggcagaaagttcaggctcacgtcgcaggaacttcggcagacaaagtcgagaagggaggatacatcgtgagtgacaattcgtctggcgaaccggagctgattatcatcgggaccgggtcggagctgtgcctgtgcgagggagcagcagagaagctg

SEQ ID NO: 365 - DNA, 628 bp, Artificial Sequence
  Synthetic
gaacttcttaatacaaagatatgctggtcataaaccaaggggggatgcaattgaagcagctcatgataaaataataatgcagaaattctatgataggaaaaacccaaaaattgactttaagaagaaagtcagggacataaaacaatctcgtgttatgcaggctgtcactagcaggttcagaacaccagctacaaatttcattgtgaaaacttctatcgctttcatagtccttggagctctcacagttctctttcctactgaagaaggtccaacgcttcaagttgccatttccctgatcaccgccatatatttcattcatgatcggttaaagagcaaacttcgagcttttctatatggaactggtgcttttattttctcttggcttttggggacattcttgatggtgtctgtgattcctcctatacttaaagggccaacgagtttggaggtgacaacttcgttgattacgtatgtacttttgtgggtttcttctacttacctcatataggactgtggcatcatctcaattttggcagggaagtacattagtttctcgatactaaaatagaggaagattattgaaactcaagccgagtcccatgattatctgttacagcttttattgcta

SEQ ID NO: 366 - DNA, 902 bp, Artificial Sequence; identical to SEQ ID NO: 281
  Synthetic

SEQ ID NO: 367 - DNA, 1017 bp, Artificial Sequence
  Synthetic
ttagcaaaaagttgctcctttgcaatctttcaagttccacctaaccggagacggagtgaaccatctcggccggcacggcctttatggaaaagttttctccacaataagctcgattttcagaaatcagtacaaaatctagggttcttattggaggggacaaatttcatggcgacaactctcatctcgaaacttaccctttcctctgctttcctcggccaacaattttcgagtagaggaaattcaatgaggtcggcacccgctggtttgtttctcaggggcccaagatgtgcggcaacggatacgccttatgggggtaatattccacagtttcctcgagtgaatgtttgggatccctacaaacgccttggaataagtcgcgatgcttctgaggaagaagtttggagctcacgcaactttttgttaaaccagtattataatcacgagagaagtgcagaatcaattgaagctgcctttgagaagatattaatggcaagcttcataaatagaaagaagacaaagattaacttgaaaacaaggctaaaaaagaaagttgaggaatctcccccttgggttcagaacctcctcagttttgtggaacttccaccgcctgtaattattttgaggagattattcctctttggattcatggcttgctggagtgtgatgaactctactgaagctggacctgcattccaggtagctatatcttttggagcttgtgtgtacttccttaatgacaagacaaagagcttaggaagagctgctcttatagggtttggagccctagtggctggttggttttgtggttcactgttggttcccatgatccctccgaatctgttgcacccaacttggagtcttgaactcttaacatctctctttatttatgtttccttgtttctgggctgtacttttctcaaatgaagctctacagaacctgttttgctgtagcagtttttacatgtcgcatcctgattaattcatggtgttccttcactattttgtaccttcaagatt

SEQ ID NO: 368 - DNA, 665 bp, Artificial Sequence
  Synthetic
tttttaaaccaaatagataggatatatttattcaaatcagaagcacattagggaacacaagaacagagacaattcaacacatgtaaatgcataaaatcaaacaaactgaaacacaaagacacttcaaacgaaagaactgagattgaaggaaccaatcatgtttgcgagagcagaactcatatctagctcaagctgaagcttctgaagctcaagctgttgcctcaaaactggatcttccacttgctctgttattgcagctacttgttccgtctgctcagtctccaaaccctgaacaggaacagattcagcagtcggtgtctttccttcatcactcgccccacagttctcagcagaagcagccactggattgggcttattcacagcacatgaagcatgaatatgatagttacaagcataacagttgtaagaccaaaacctaccatccatagtcatattacaaagattgcaaacaagctgattcccgaaaccaaactgagtaaaagacataggaggagtactgttgtagacaagaagaagactatgcataggatgagactcatgaaccaagacctgaggcaggtgagcgcattgaacatgaaggtcaaagtcacacaaaggacaacagtaagagaaccctttacctccagtgcagccacaggctctgc

SEQ ID NO: 369 - DNA, 700 bp, Artificial Sequence
  Synthetic
  misc_feature (397)..(397): N at this position can be a, c, t, or g.
gtcgacccacgcgtccgctctttccttctctcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttnttcggtttctacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaatcttcagtgtagtaaaacaaatgtaaattttttaattatggagtttcacttgttttt

SEQ ID NO: 370 - DNA, 627 bp, Artificial Sequence
  Synthetic
attaaaagatgatgatgatggtgcaagcatgtcctctctctcacaactctctcccaactccatcacacttgcaatctctctctcccatgctatcaagcaagggagggaggggtaaggggagcaaaagcatagtgaaggcttccttattgtgggagcccaattcaacatcaatcctcctagagagcatagcacacccacactcttggagtgccctcctccctgtgatggtgatagacccttggtcccccaacataaaggcagatagcatagcctctcagctctttgcagcctccctcttcccctacctgggcttcctttaccacttgacaaagtcaaagacttcccccaacctcaccctctttggcttctacttcttgcttgtctttgtggctgccactattcctgccggcatttatgcaaaagtaaagtatggaacatccttagcaaatgtggattggcttcatggaggcgctgagtcttttcttacccttacaaatcttttcattgtaattggattgaggaaagctttacgcggcgatgatagtgttccaaaatctttctcagcaaaggacggtgaaaccatagaagagagctcacccctttcaaataaatgtatggctgatgagg

SEQ ID NO: 371 - DNA, 590 bp, Artificial Sequence
  Synthetic
  misc_feature (465)..(465): N at this position can be a, c, t, or g.
tgactgattactactacttgtactaactctaatacatttacaaaacaagtcctccttttccccaagtatacagataaagatttaccagaaccggttttccgccttcatctcacatggaaatcgtaaggagaagacgcatacacttgatctggaaccactagtggtaacttctcaatgtacataaacaatcgtttctggttctctctagcgattgcagtgagattcactgtatcgttttggtccaaaaacatccagagatcacctgaatctactcttttaaggctgtctctgcagaacgggcatgactgtgatctccctcgccaatcgcggtaacacttgatgcataaagaatgagtacagtttggtagcaccaccttgctgttcatctccatacagattccacattcttcttccctctcgatctcaatctccgacatttcgctctcatccttctttctgtatcgnatcttgcatacctctttttgtttgctgtcatctatgtctgtaacacccctttgtagttgtgacaaagatggtaatatcacagcttggaactctcttatactggcttttctttcgtaaaccgacat

SEQ ID NO: 372 - DNA, 502 bp, Artificial Sequence
  Synthetic
agagagtttatggcaaatggccttcgagtgtggatattcagcggcgacactgatggaagagtgcctgttacttcaaccaagaattctattaagataatgaagcttcctatcaaaactgcgtggcacccctggtatctcagtgcagaggttggtggatatacacaatcatataaaggagatatgacatttgcaaccgtacgaggggcaggacatcaagtaccaagttatgaagcagctagatccctttcacttgtcatgcattttcttgctggaactgaacttcccgataaacacacttaactacttttctagtcaatatctgaacccttaagatccttcattcgtttcatgcatttatgggttcaggttttaacgtaatgtggcattccttcttctatttttcatttctcgaaataatctccggtatttaatttttagtagaattaaatttttctataacaattattttttataatattactttattatgacagccgaaatt

SEQ ID NO: 373 - DNA, 403 bp, Artificial Sequence
  Synthetic
cccacgcgtccgattaggaataaggcgcgtgctttccagcttctgcgagcaaaactgtatgaaataaaagtaagggaacaacaagagaagataaggaatgaaaggaaatctcaggttgggactggagctcgttcagaaaagataagaacatacaattataaggacagtagagtgactgatcataggctaaagatgaactttgcgcttacaacatttcttgacggtgctttagaggacgcagtgcaggcttgtgctgctttggagcaaaaggaactcatggaagaactctccgagtctgtagctgcttcttctgctacttctggataaatcctcaaactatactccaaggaaaactttgtagttgtacacacatcataattataagacttttattcattcaaaa

SEQ ID NO: 374 - DNA, 329 bp, Artificial Sequence
  Synthetic
gacgcgtgttgggaatccaacttaccaattgcaatggcgtcaatgaccatgacatcttgatttctccctaccgtctcaaaccttccggcaaacatctccagcaacagcagacgaagcctcacggtggtcaaagccttcgggagtgaaaacacaaccagcttggagaacaagaagcaagaacagagcatgaacatgaggagggatcttgtcttcacagctgcagctgcagctgtgtgctccttacctaaggtggcaatggcagacgatgagccaaagagaggaacagaagctgccaagaagaagtatgctccagtctgtgtcacaatgcc

SEQ ID NO: 375 - DNA, 750 bp, Artificial Sequence
  Synthetic
tttttttagatattaaagagtacaacaatgttgattaacttagttcctctgtacattgaagattccaaatttgttcatggagctacaacggttcaacaataattcaagctcaaaaaccaagaactctaagatgaaacacactcacagacagacatgaaagtgatggaagatagataggtatgagatcataagtctgtcttcactctttagttgaaggtttggacaatagtgttgtgccatgggtcagacaagtgctgcaacagattctcaaatggtccttttccagtcacattgtgttgaaccacaaaccctaagaatgccaacatcgccaacctcccgtttgctagctctttctccttggcctcttgcgtaggagcaaagttaagcgggttaaagattccaccagggtaaccaacttcacccttaggtaagctgtattgcttaaagatagggtcttggttcacacttcctgggttcttgatgtcttgccaccgtctgatctcaacgtaatgaaacaatatgaactcgatcacgaacaatgtcgacgacgatgcaaaatactgctctttcccagcatcgtaccactcaggaacatttatgattccgatcttggtgaaaacttccggcaaaagcatcccagcgacaccgagcatagcccatcgtccgttgaccagctctgcctggacgaaccatttcaagttctctggatcctctgctagacccaacgggtcaaacccattgtcaccggca

SEQ ID NO: 376 - DNA, 359 bp, Artificial Sequence
  Synthetic
cccacgcgtccgcgggtttccatgttggctcagtgcgtgaagcaacaacaacagcaacagcagcagcagcagcagcaacatcagttccgtagccttagctccagagagctcagaacaaactctagcccaatcgttggttcaccggtaaacaacaacacatggtcatcaaaatggggatcttcaaatggtcaaccggattggggaatgagctcagaagcacttggtaagttgagatcttcgtcatcgtttgatggtgatgagcctgatgtgtcatgggtccagtcactggtgaaggagactccagcagaagccaaagagaaagcagcaacatcttcctcaggggaacacgtgatgaagca

SEQ ID NO: 377 - DNA, 184 bp, Artificial Sequence
  Synthetic
acaaatagtcataacaataaaatatataaaaaataataatattaataacaataataataatgataatgggagaaagaaatccctaaaaaaaaattgaaaatgggagaaagaaaaccaagaagggtttgtttcatctcctttcttcccataagcctttttcttgtattggtcccttctcttctct

SEQ ID NO: 378 - DNA, 625 bp, Artificial Sequence; identical to SEQ ID NO: 21
  Synthetic

SEQ ID NO: 379 - DNA, 422 bp, Artificial Sequence
  Synthetic
gggggttcaagctgttgttaaaaaatatgatatcttgatcattgctgatgaggtgatatgtgcatttggaaggctcgggacaatgtttggctgtgacgaatacaacattaagccagatcttgtgaccttagctaaggcactgtcttcagcatatatgccgattggagccattcttatgagccaagaagtggcagatgtcataaattctcatagcagcaagctaggcgttttctcccatggatttacttattctgggcatacagtttcgtgtgctgtagcaattgaagcgttaaagatatacaaggagaggaacataccagagtatgtcgccaaagttgccccaaggtttcaagatggagttaaagcgtttgcctctggtagtcctattattggagagacaagaggaacaggtttgattcttg

SEQ ID NO: 380 - DNA, 608 bp, Artificial Sequence
  Synthetic
caagaagaaatttattgcacgatcaaaatcataccatggatcaacactaatatcagctagtctatccggtcttcctgcactgcatcagaagtttgatctgcctgcaccttttgttctgcacacggactgccctcactactggcgcttccatcttcctggtgaaacataagaagaatttgcaactagacttgccaataatttagaggaacttatcctcaaagaaggaccagaaacaattgctgcattcattgcagagcctgtgatgggtgctggtggtgtcatacctcctccaaagacctattttgaaaaggtccaagcgatcgttaagaagtatgacatccttttcatagcagatgaggtcattactgcatttggaaggttgggaaccatgtttggaagtgatatgtataacatcaagccagatctagtctccatggccaaggcgctttcatctgcctatgtgcccattggagcaattatggttagcccagaaatatcagatgttattcattctcagagcaataagctcggttcatttgctcatggatttacatactctggccatccagttgcatgtgctgtcgccatagaagccctgaaaatttatc

SEQ ID NO: 381 - DNA, 205 bp, Artificial Sequence
  Synthetic
ggggggccccattatgggttattcctcattaaaagggccttatttaaagacttgtggggggttaaaaaaaaaaacaagggatccaacctttgagaatttaaaaaacttttttcataaacatcatttggactctgtttttcactttttgggcggacccttgagtttttttacctttttttccgtggccttaaaggctttcccataa

SEQ ID NO: 382 - DNA, 525 bp, Artificial Sequence
  Synthetic
aaaatctggaagatcttatcctcaaagaggggcctgaaacaatagctgctttcattgctgaaccagttatgggggcaggtggtgtcatacctcctccagcaacttattttgacaagatccaagctgtggtgaagaaatatgacattcttttcatagcggatgaggtcatctgtgcctttgggagacttggaacaatgtttggctgtgacaagtataacatcaagcccgatcttgtctccctagccaaggctctttcttctgcatatatgccaattggagctgtccttgtaagccctgaagtttctgatgtaatatattctcaaagcaataaacttggttccttttctcatggatccacttattctgggcatcctgtgtcatgcgcggtggcattggaagctcttaagatctacaaggaacgaaatatggttgagaaagtaaatagaatatccccaaagttccaagaaggtctgaaggcgttttctgacagtcccatagttggagagattaggggaactggtttga

SEQ ID NO: 383 - DNA, 1508 bp, Artificial Sequence
  Synthetic
  misc_feature (206)..(206): N at this position can be a, c, t, or g.
  misc_feature (260)..(260): N at this position can be a, c, t, or g.
  misc_feature (329)..(329): N at this position can be a, c, t, or g.
  misc_feature (338)..(338): N at this position can be a, c, t, or g.
  misc_feature (345)..(345): N at this position can be a, c, t, or g.
  misc_feature (359)..(359): N at this position can be a, c, t, or g.
  misc_feature (365)..(365): N at this position can be a, c, t, or g.
  misc_feature (422)..(422): N at this position can be a, c, t, or g.
  misc_feature (427)..(427): N at this position can be a, c, t, or g.
  misc_feature (430)..(430): N at this position can be a, c, t, or g.
  misc_feature (455)..(455): N at this position can be a, c, t, or g.
  misc_feature (495)..(495): N at this position can be a, c, t, or g.
  misc_feature (564)..(564): N at this position can be a, c, t, or g.
  misc_feature (592)..(592): N at this position can be a, c, t, or g.
tttgagggcttacggaagaatgggtgaagacgctctaaaggatgaggcactgcggcacaacatgttgtcgccgttcacggctggaagccaaatgatcaaaggggatccattgatcatcgaaaaatcagagggaatttatgtgtatgatacgcatgggaataagtacctggatgcccttgctggcctctggaacattgcgctcgganggaagcgagcctcgtcttgtggaggccgcaaagaagcagctcgatgttcttccngtactatcactctttctggaatcgcaccactccagtcacactggagctcgcgaaagagcttgtggaggnttttcacangcggttnaagatgagccgggnttttcnttcacgaacagtggctcggaatctaatgactctcaagtgaggctggtttggtattanttacnaantgcgattgggaagccacagaagaangaagtttatagcacgggagaaagcatatcatggatcaacngtacgcatcagccagtctctcgggtttatcgaatctccacataggctttgacgcgccggcgtctttcgnttgttcatactgattgcccgcattattnggcgatatcacttgcctgatgaaagcgaggaggaatttgctacgagattggccgagaatctagaaaagctaattttgaaggaaggacctgaaacaattgctgccttcattggcgagcctctcatggctgctggcggtgtcatgccacctccagctacatactgggataagattcaaccgattctcaaaaaatacgacatacttctcattgccgacgaggtcgtctgtgcgtttggaagacttggaactatgtttggctgcgactactacaatataaaacccgatcttgtcagcttagcaaaggctttgtcttccgcctatttgcctatcggagctgttctcgtgagcgaaaaaatttcggacgctattgtgaaattcagtgacaagaatggtgctctcggccatggatttacgtattctggacatcccgttccctgtgctgttgctctggaagcattgcgcatatacaaggagagagacattcccggacacgtcaggaaagtttctccccacttccagaaaggtttgaagaaactcatctccagtccagttgtgggagagattcgaggaaccggcttgatcattgggtttgagttcaaagacgggaagcgtccagagaacacatttccagcagactggggagtatcgacatatttcgcccagaagtgcaaagaggaagggatgcttgtacgattgtctggagatgcaatcttcatgtctccaccgctgataatcacagttgaggaaatcgacgagcttatcgggatgtttgagaaagctctcaaggccaccgagaagtatgttgaatccaagaaacacagtggatgatagcgacgagcaaaacgatggtaaaatacttctttccatacttgttttagtgcaaaaacgatcaactttctaatgagtttaagtcaaac

SEQ ID NO: 384 - DNA, 163 bp, Artificial Sequence
  Synthetic
gaaggcgttttctgacagtcccatatatggagagattaggggaactggtttgatcctcgcaacggagtttgcagataacaaatcttccaatgatcctttccctcctgaatggggtattggtgcatattttggagcacagtgtgagaagaatggtatgttggta

SEQ ID NO: 385 - DNA, 560 bp, Artificial Sequence
  Synthetic
gctctatgttgggcgagggacaattgtcacaacctttatcgtctgctatgcactcacttcgttcatcgcaggctatgtgagtggaggcttgtactcgaggaatgatggtaaacattggatcaagtcaatgtttttgacatcttccctctttccatgcctgtgttgcggcataggctttgcactcaacacgattgcaattttctaccactcgcttgccgccattccatttggtaccatggtggtggtggttgttctatgggctttcatttcgctacccgctagctctgttgggtactgtgtttgggaggaattgggctggtgttccggacaatccttgccgagtcaaaaccattcctcgacccatcccagaaaagaagtggtacttgaagccattaatcgtgtctcttatgggggggctgcttcctttcggaagcatttttattgagatgtacttcgtcttcacatccttttggaactacaaggtatactacgtatacggcttcatgttgctggtgtttatcatccttatgattgtgaccatatgtgtgacgatagtggga

SEQ ID NO: 386 - DNA, 708 bp, Artificial Sequence
  Synthetic
cccccccctcaaatcggggaggattgatgaccgcgatgcttcttgtctgggtcttgatggggttgcttgctggttatgcttcttcacgcctctacaagatgttcaagggttcagagtggaagagaataactatgcgcacagccttcttatttccagggattgcttttgttatcttcttcatattgaatgctcttatttggggggagaagtcatctggtgccgtccctttcaccactatgttcgccttggtcctcctttggtttggtatctcagtgcctcttgtgttcgttgggagctatcttggattcaaaaaacctgccctggaacctccagtttaaaaccaacaagattccaaggcagatccccgagcaagcttggtacatgaatccaatcttcactattctaattggtggcattctaccatttggtgctgttttcattgagctattcttcatcctcacctcaatctggcttcaccaattctactatatctttggcttcctcttcctcgtctttgttatcctcatcatcacctgtgccgagattacggtcgtgctctgctatttccaactgtgcagtgaggactacatgtggtggtggagatcttacctcacttcgggatcctcagcactttatctcttcttatatgctgctttctacttcttcacgaagctgcagattactaagctggtgtctggcatcttgtac

SEQ ID NO: 387 - DNA, 431 bp, Artificial Sequence
  Synthetic
ggcaaataccagagcaagcatggtacatgagaccagctttttctatacttattgggggtattctcccatttggagctgttttcattgagctgttcttcatcttgacctccatatggctgaaccagtactactacatctttggtttccttttcatcgttttcctgatcttgatcattacatgtgcggagatagccgtcgtgctttgttacttccagttgtgcggtgaagactatcattggtggtggagagcttatctgactgctggatcctctgctttatacctgttcctatactccatcttctatttcttcaccaagttggaaatcacaaagtttgtttcaacaatcttgtattttggctatattttgattggattatattccttctttgggttaacaggaacaattggattctatgcttgcttctggttt

SEQ ID NO: 388 - DNA, 731 bp, Artificial Sequence
  Synthetic
gtcgatgatccttacagcgtcacttttcccctttatgtgctttggcattgggttcattctaaacacgattgctatattttatggatcgttagctgctattccctttggaacaatggtggtggtttttgttatttgggcttttatttcattccctctggcgcttctgggtactgttgtaggaagaaactggagtggtacgccaaacaatccgtgccgtgttaagaccataccccgtcctatccctgagaagaaatggtacctcacaccatctgtaatttctctgatgggaggtcttcttccctttgggagcattttcattgagatgtattttgtcttcacttccttctggaactacaaggtctactatgtatatggttttatgcttcttgtatttattatcctgatcattgtcactgtttgtgtgacaattgtgggcacatatttcttgctgaatgcggagaactaccattggcaatggacttcgttcttctctgctgcctcaacagctctctatgtgtatttatatgcgatatattactatcatgtaaagaccaagatgtccggtttcttccagaccagcctttactttggctacactatgatgttctgccttggcctcggtattctttgtggtgctgtaggatatctcggctctaatttgttcgttaggaggatttacaggaatatcaagtgtgattaagcgcctaaatgaagcaatattgaaatgctgc

SEQ ID NO: 389 - DNA, 1066 bp, Artificial Sequence
  Synthetic
gtccattggttctctatcggaaactcttgtgttacagtcctccttttgactggattcttggcgaccatcctcatgcgagtactgaagaacgattttgtcaagtatgcccatgatgaggaagcagctgatgaccaagaagagtctggatggaagtatatccatggggatgtcttccggttccccaagaacaagtcctttttttcggctgctctcggcaccggaactcaactgtttgccctcacaacctttatattccttcttgcacttgttggagtattctacccgtacaatcgtggtgctctttttactgcattggttgtcatctatgctctcacttcaggaattgctgggtatattgcaacctctttctactgtcagctagagggaacaaactgggtgaggaacttgctgttgacaggatgcctgttctgtggaccccttttcctgactttctgcttcctaaacactgttgctattgcttatagtgcaacagcagctttgcccttcggcactatctgtgtcattgtgctcatctggaccttggttacatttccccttctagttttgggaggcattgctggtaaaaacagcaagactgaattccaagctccctgccgtaccaccaaatatcctatggagattcctccacttccgtggtaccggcaaacaatcccgcagatggctatggctgggtttttacctttcagtgccatctatattgagctctactacatctttgctagtgtttggggccacaggatttacacaatttacagcattctcttcatagtcttcatcatcctccttattgttactgccttcattactgttgcactgacgtactttcagcttgctgctgaagaccatgaatggtggtggaggtcattcctatgtggaggatcaactggatttttggtctatgggtattgtctgtactactattatgcacgatcagatatgtctggatttatgccgacatcattcttcttcggctacatggcttgcatctgctatgctttcttcctgatgctgggcatgatcggtttccggtgccgcattgttcttt

SEQ ID NO: 390 - DNA, 921 bp, Artificial Sequence
  Synthetic
ccccctcggattcttatccccttcaaatcgcggaggattgatgacagcaatgttgcttctctgggcattcatgggtgtgtttgctgggtatgcttcagcccgcctttacaagatgtacaaaggaactgagtggaagaaaattactcttaagacagcactcatgttcccgggcattgtttttgttcttttctttgtgttgaatgctctaatttggggagagaagtcatctggggcagtgccatttggaaccatgtttgcactagtattcttgtggtttggcatcgcagtgccactcgtttttgttggtagttatgtaggttttaagaagccagccattgaggatcctgtgaagacaaataagatccctcgacagataccagagcaagcctggtacatgaatccagttttctctatccttattggtggcatacttccatttggagctgtattcatcgagctattcttcatcctcacgtcaatctggttgcagcagttctattacatatttggtttcctcttcattgtgctcgtcatccttatcatcacctgtgccgagatcaccattgtgctatgctatttccagctatgcagcgaggactacctttggtggtggagatcatacctcacttcagggtcatctgctctctacctattcctgtatgcagcattctatttcttcacaaagcttgaaatcacaaagcccgtatctggtatgctgtacttcggctacatgttgatcgcatcatatgctttctttgtcttgactggcacaattgggttctacgcgtgcttctggttcacgaggctcatctactcatcagtgaagattgactagaagtgtcgtattgcagttccttgggagagcatatattacactgcggaccaaattgtttgttgcttccaggttttgatagtataaag

SEQ ID NO: 391 - DNA, 680 bp, Artificial Sequence
  Synthetic
  misc_feature (601)..(601): N at this position can be a, c, t, or g.
aatcgcaggtgaggaacttgcttctaacaagctgcctattctgtgggccattattcctgaccttctgcttcttaaacaccgttgcaatcgcatacacatcaactgctgcacttccttttggtacaatcatggtcattctcctcatctggtgcttggtaacatctcctcttttggtccttgggggtatcgctggcaagaacagcaaagctgaattccaagcttcatgccggacgacgaagtatccccgagagattcctgttcttccttggtatcgaagcgccattccgcaaatggcgatggcaggattcttgcctttcagtgccatctacattgagctttactacatttttgcgagcgtctggggccacaaggtgtatacaatctatagcatcctctttgttgtgttcatcatcctgatcattgtcacggctttcataacaatcgctctcacgtattttcaacttgcagcagaggatcatgaatggtggtggagatctgttctatgtggggggtcaacgggcgtgtttgtatacagttactgcttctactactattttgctcgctccgacatgagcggcttcatgcagacatccttctactntggatacatggcttgcatttgctatggattcttcctcatgcttgggatggtcggcttccgggcctctctcttcttcgtt

SEQ ID NO: 392 - DNA, 521 bp, Artificial Sequence
  Synthetic
cgcgtcgcaggaacgctctgtgtcttcgtgggaccgggagtgctgtgccttggcatgacggtcgtgacaatgatcttcgcactcttgggattctctcgccttcgaaccggggtggactcatgaccgccatggtgctgctgtgggtgtttatgggactagtagcgggctacacctcggcacgcctctacaagtctttcaagggcactaacttgttttaagattaccatgaagacggcgctcatcttcccgggggtcatattcaccatcttcttcgtgctgaacgccatcatctggggagagaagtcgtcgggagcagtgcctttcggaacaatgttcgcgctggtctgtctctggttcggcatctcggtcccgctggtcttcgtgggcagctacttgggattcaagaagccggcaatcgagcctcctgttcggaccaacaagatcccgcgacaggttccggagcaggcatggtacatgaagcccgtcttctcggtcctcatcggcggcatccttccattcgg

SEQ ID NO: 393 - DNA, 540 bp, Artificial Sequence
  Synthetic
ttctcatctcacctgctcgcaatggcgatcaagaagagctcgacgcaggcgtttcccatgggcggcggcggcgccagccttctcctcggtctcctcctcgtcctccccgtgccagccgtctcgtcgtcggacgcggaggaggcggtggtctcccggttccgggagtacctccgcatcgacacggcgcagccggcgccggactacgccgcggcggtggcgttcctccgggggcaggccggcgccgcggggctcgaggcgcgcacgctcgagctcgtcgccggcaagcccctgctgctgctccggtggcccgggcggcgcccgtcgctcccttcgctgctcctcaactcccacaccgacgtcgtgccgtcggagccggacaagtgggaccacccgtccttctccgccgccctcgacgaggcatccggccgcatctacgcgcgtggctcccaggacatgaagtgcgtggggatgcagtaccttgaagccatccgccgtcttcgtagtgcaggctttatcccagatcggaatatctatcttaca

SEQ ID NO: 394 - DNA, 627 bp, Artificial Sequence
  Synthetic
tgaaaaagcaggaatgaataatacaatttgccaatgccaactgggggacaacaagaacaagatgtctctgatttaccacaacaaacacaggatggattcagatcttattgattgtacaaatttgcgaaaggaagacttgaatgggctgtgttgagaccctcataactcatctcgtgaaccacttttgctttcatatgatgcataagctttgatgattgaaacatacacctcaatgcctttcaagtactcagctttacccaaatactcattgtggtcatgaagcagactcggggtgtttgatatgggagagaacccaaaggcaggcacgccagccttgcgaaagtagcgagcatccgttgatgcagggaaaatctcaggcttactggtcctacctccggcttccttaacagcattttccaagagcccccaccaaggatttgaatcatctgctgctgtaaggaattgcttccccgtaagcttctgcttgaactcaaaggacatgtttcgtgctgctggagcccattcctccactaaacgtctttcgagtgcttcagcatcaacgctgggtggaacacgaatgtcgaaaccagcttctgcctcagatggttgcagattcattacgaaacc

SEQ ID NO: 395 - DNA, 656 bp, Artificial Sequence
  Synthetic
tttttttttttcttgctcgtcttttttcaatttttctataataatgacgagtatcaataagaacaaaaatatacactaaactttgagttttccaaagatttgacgggtacatcctcttatttttttctgagctaaagttcagagtgcgtcaaggattcgtcgttcgattcgtcgttcgattcgtcctttattccaacaaagctcgcgagagaattcaagagaatttggtatacttcgatgcctttgaagtattctcgagaatttagaaactcatggtgatcgtggagaagaacgggagtgttagccatcggcgagaatccaaatgctggaattcccaagtcgcggaagtagcgagcatcagtcgaggccgggaagatctccggtgtggcaagcttctggttcgactttgatatcgcttcccggaacactgaccaccagggattggagtcgtccactggagtataacttaaagcgccatcctttctcctgatcggtgtcttctgcttaaactcgtaagtcatatttcgcgatgcgggagcccattcttccgcgattctcttctccatggctgcgggatcagcaaaaggcggcattcttatgtcgaaaccggcctcagcctcggatggctgtagattcatcacaaatccagttggggt

SEQ ID NO: 396 - DNA, 663 bp, Artificial Sequence
  Synthetic
cccacgcgtccggaagaatccgaatccaattcaatgagtcttcttcgtcttctcctcgttgttgttgttcttcatctttctgcggtggccggcgacgacgccatcgtctccagattccaggagtacctccgaatcaacacggttcagcccaacccggaatactacaaagccgttgactttataatatctcaggcgaaaccactgtccctcgaatctcagacgatcgaatttgtaaaaggaaagccgcttctcctcctcaaatgggttggctccgacccaaccctacctgcctttctcctcaactcccacaccgatgtcgttcccttcgaggactccaagtggactcaccatccgctccaagctcacatggaccaccatggcgacatctatgccaggggttcccaggacatgaagtgcgtcgggatgcagtacctcgaggccatacgcaagctccaggcttctggcttcaagccactccgatccgtctatctctccttcgtccccgatgaagagattggcggccacgatggcgcagagaagtttgctgaatcccaattattcaagagcttgaacatcgcaatcgtgctcgacgaaggcctgccatcgcctactgagagttacagagtattctatggagagaggagtccctggtggctggtgatt

SEQ ID NO: 397 - DNA, 314 bp, Artificial Sequence
  Synthetic
aaaaggttcaaaatcataacccaaaacaaaagaaataaacaggaagctcgagtgccaagtacctccgccacctccgatcaaaaacccaattccgagaattgagctccgacggaaaataaacgaagcggtaacacaaacaaccaaccaaataccaaactactaaagtaaagaaactaaaatagtccttcatttcatcagcggaaagagttttgatgttcaagttaacttggcaccctttttgactgcaaccttggtaaccttggctccaattgggtccttcttgtcaacactcttgataacaccgactgcaacag

SEQ ID NO: 398 - DNA, 616 bp, Artificial Sequence
  Synthetic
cccacgcgtccgtgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggaatatacaaatcaatccaagtggtcttggtacgggagagggaaaagctttgtcgatgtatcttggccttaatgtgaatgagatattcagaccatatgagaagatttatgttcgagccaagcttcgagctcttaaccaactcaatctcagtaacatcgaaagggaactcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctccatgtgtttgatttgttatcaaatactaataagaatttgattatgcatttcaaatacaattgtttctttttcttaaaaaaa

SEQ ID NO: 399 - DNA, 390 bp, Artificial Sequence
  Synthetic
aatgagttcaaatctagcgactttcgtcgtatgaagaaacaagttgctcggatgttgacggttaaaagagagagggagatcaaagaagggataaagaaaaggttgtcgaggaaacttgacagacaatggaagaaaagcatagtaccaagaccacctccgtctctgaagaaacttcaagaagaagaagctgcagaagaagcagctgaagctgctaaatctgcttgaaaaaacccgctattgatttatggtctcttccttgttgtttcctcgagatgttgttaatctctgttatttgttgctgaaccatcttgtatttgtttttcttttggtgtaaacactttccttatcaagtagtttacatgaatcccttaaagcggccgcaagctcgag

SEQ ID NO: 400 - DNA, 337 bp, Artificial Sequence
  Synthetic
ttttttaaaatttaaaaacatattttcaaatcaatgtaaaatagaaacgttgaagagagaaacaactgaagaatgggggcaaagcgccagaaacttgtaaaaacaagtaaaaggattggcaaaagtaagaaagcacaccactttaaaactaacattaagctttggatgatgatgattcttcttcgtcatcttcatcaatgtcccaacttaaatcttcatcttcctctgcagcactcagacgtttacgagctcagctctgtttggactaccaccagaccgactcgtttccttaccatctatgctactcatatcctcgatctcgtcccatcccaaatcc

SEQ ID NO: 401 - DNA, 490 bp, Artificial Sequence
  Synthetic
atgcacctcctctctgcgcatgcatttctctgatcccaaccctggttcgaaccctaaccctaactctaaccctaaccttagggggggttgggttggagtatccccgggcctgcccccgctaaagaatccctgctgctgccggcgggggccggcccagctacgccgggttgcttgcgaggttgctgtcgaggtcgggggccagaaggtcgatggcgatgacaatggagcggggaaagcggctgcgggctcgcgcgtgcgcgtctcggtgccccttactgtctaccatgtcgccaaggccccggaattggacctggagggccttgaaggcgaggtcaaagatattctccacagcttcaaaggcaagcccatctccgccaatctgccctacaaggtgcagttctttctcgacgtcgacggcaagcaggtcaaattcttcgcccacttgaaggaaggggaattcgaggttattgcttgatatccaatctccccc

SEQ ID NO: 402 - DNA, 713 bp, Artificial Sequence; identical to SEQ ID NO: 198
  Synthetic

SEQ ID NO: 403 - DNA, 652 bp, Artificial Sequence
  Synthetic
  misc_feature (508)..(508): N at this position can be a, c, t, or g.
atgactgcttcaagttcagcttcctttacatcatcaattctcaacattcccaattctaaaacctcatctttcattttaaatcctaacccttttccccaaatcaaagttaacaaatcaagaaaccctaaaaaaacaaatgggtatttcatttctaggtctgtaacagtcgataaccccaccactgtatcctcttcatctgcattgaacttagatgagggaattgatgaaaaaactgctgaagcaattgggaaagttggatctagggttagggttacggttccgttgaaagtgtatcacgtgcctaaggttcctgaattggatttggtaaatagaattggaactttgaaacaatacgtgggttttcacaaaggcaaacaaatatcagctaatttgccttacaaagtggagttcgtggtggataatttggaagggcgagatggtcaggttaagttcttggcacatcttaaggaagatgagtttgagtttcttgactgatttaatctctagntttttgatttgataattttagtgctttctaaatgattactgtgttccaccgaatatatgagaataataatgtgtacaagtattattttcgtgtatcattttgtacatctaattttttaaataaaaaagatggttattttggctc

SEQ ID NO: 404 - DNA, 600 bp, Artificial Sequence
  Synthetic
cccacgcgtccgcggacgcgtgggcgccaacggcgacgtctcctcgccgtcctcggacgtggccgccgaggagtccgcggcggcccccaagatcggcaagcgcgtgcgcgtcacggcgccggtacgcgtccaccacgtctccaaggcgccggacctggacatctgtggcatggagggtgtggtcaagcagtacgtcggcatctggaagggcaaacgcatcacggccaatctccccttcaaggtggagttcgagctcagggtggatgggcaggacaaaccggtccggttcttcgcccaccttcgagaggacgaattcgagctcgtcgaagacgaatagctgaataggtctcttttacagaataatgtgctctcgtcgtctgcagtctgcagatgcagtatctgtatattagaagagaagattgaagagggtgcgaggagatcgcaagtaagttgttgtttgtttacttgtcgcgtgctcttcctcactcttttgtagttctgttaaacaccaacattttgagatttgagaaactgagaacggttcggattatgacaattatgaatgaaagtggttatactgatggttctgttgttggctgt

SEQ ID NO: 405 - DNA, 424 bp, Artificial Sequence
  Synthetic
ggtttttggaaaaaacccttatgtatatgattgctaagggttgaatacacatcaccctacatacaaatcattctccattcccgggttccagtaaacccaacaaacaaaaacaaaccctgaaaagggaaaccaaaaatcgctttttttgttcaatgactgaacaatgaactcaaactcattttccttaaaatgggaaacaaatttaacaacaccacgaccttaaatttttttgaagaactcatttttataaggaaaattaactgaaattcatttccctttccaaacagaaacgtatttttggagttaaccttccataccttttaaatcaacctttgaacctggatttacatgataaaccttcagcggcgctgttactttaaccctagatcctatctggaccttgggttccgtttcatttttttcc

SEQ ID NO: 406 - DNA, 639 bp, Artificial Sequence
  Synthetic
ccccccggtgcacgtacgtgtagccgccgccgcagatagtacaccggctatctatccatctatctactcagctttgcgtcctcccgcgaattcaccgcagcaatggcgtccctcgtcgccgtccagccggtcgccgtgaagggcctcgccggcagctccatctccggcaggaagctcgccgtcaggccgtcgccccgggcgctctgccgcaccacccgcaggccgcgcgccgccgtggtggccaagtacggcgagaagagcgtctacttcgacctcgaggacatcggcaacaccaccgggcagtgggacctgtacggctccgacgcgccgtcgccgtacaaccctctccagagcaagttcttcgagacgttcgcggggcccttcaccaagagggggctcctgctcaagttcctgctgctcggcggcggatcgctggtggcctacgtcagcgcgtcggcgtcgccggacctgcttccgatcaagaagggcccgcagctgccgccgacgcccggcccacgcggcaagatctgaattaaattcctcgtctctgcctcaccttcttcttgatccgatccatccatgcaaatcctctgtactgtactgctagtcccccatggccggatcgccatggattaattc

SEQ ID NO: 407 - DNA, 424 bp, Artificial Sequence
  Synthetic
aattcggcaccagaaaattcccactcaccacacacaacaaaagaatagtgatcgaagctcatggcgtctcttgcaaccgtcgccgctgtgaaaccatccgccgccataaaaggactcggcggcagctcactcgccggagctaagctctccatcaagccttcccgcctgagctttaaacccaaatccatccgggctaatggtgtggtggctaagtatggagacaaaagtgtctactttgacttaaaagatttgggtaacacaacaggtcaatgggacgtatacggctctgatgctccttctccttacaatcctcttcagagcaagttctttgagacattcgctgccccattcacaaagagaggattgctcctcaagttcttgatccttggaggaggctctttgcttacttatgtcagcgctacct

SEQ ID NO: 408 - DNA, 608 bp, Artificial Sequence
  Synthetic
  misc_feature (209)..(209): N at this position can be a, c, t, or g.
ctgaattctgaaaatagttttgttagtttggagtgaaaagccatggcatctttggcaacctttgctgcagtgcagcccactaccaatgtcaagggcctagctggaagctccattactggaactaagcttcatctcaaatcatctcgcctcaatttgaagaccactaaatccagggccggccctgtggttgccaaatatggtgacaagangtgtatactttgatttggaggatttgggcaacaccactggccagtgggacctgtatggatcagatgcaccttcaccatacaactctcttcagagcaagttctttgagacatttgctgctccattcaccaagagaggtcttttggtcaaattcttgatattgggaggtggctccacccttgcttacttcagttcgacagcatcaggggatatcctaccaatcaagaaaggtccacaacttccacccaagctcggcccacgcggcaagatctaattgctttcggtccaaaattcaaccttcaatttgtaattgatgtatgtttccccagtttgtgtaagtataattgaagactttccattataacaagttatatcttatggaaaatttgtagcattgcttt

SEQ ID NO: 409 - DNA, 531 bp, Artificial Sequence
  Synthetic
gaagaacactcttgtaagaggcgatggccgccgcaacagcagcagcattggtaccgtctggacttgccaacagcagcttgaatggaacgaagctgcgaatcaagcctgcaggacaagtctcaatgagaagatccactgccaagctcggtgtatcggcaaagtatggagaaaagagcatctacttcgatcttggagatatcaacaacaccaccggagcttgggacttgtatggatctgatgcaccttctccttacaacggactccagagccgattcttccaaatcttcgctggtgctttcaccaaaaggggcctgttgctaaagtttctgctgcttgccggtaccggtgctgtcgcttacgctggagttaaggcatccccgacttacctccctgtcaagaaaggagccgtcgggccgccaacgccaggtcccagaggaaagatctaaactccattccaaattaccgagaccatccctgttctgtaagttcgccaccaggaatgtaatcttcttccttcttgtggaaaaaaaa

SEQ ID NO: 410 - DNA, 545 bp, Artificial Sequence
  Synthetic
gtgaagagcatggcatcttgggcaactcttgctgcagtacagcccacaactgccgtcaatgggctagctggaagctccattattggaactaagctacatgttaaatcatctcgccttaatttgaagtctactaaatccagggctggttctgtggtagcaaagtatggtgacaagagtgtatactttgatttagaggacctgggaaacaccactggccaatgggacttgtatggttcagatgcaccttcaccatacaactcccttcagagcaagtttttcgagacttttgctgctcctttcactaagagaggtctgttgctcaaattcctgatattgggaggtggctcaactcttgcatacttcagttcaactgcatcaggggatatactaccaatcaagaaaggacctcaacttccacccaagcttgggccacgcggaaagatctaattccttttcaatccaactttctcaaccttcattttgtaattgatgtatctgtccccagcttgtaagtattcttgaagcctacctgagacctttgttac

SEQ ID NO: 411 - DNA, 794 bp, Artificial Sequence
  Synthetic
gaattcatgaagaacaaatctcagtataaacgagaaaaatctactacgtagagccgttctaaagctcggttaagaatacaaatggaaaatcaaaccctatgcttaaaaatattcttccttttgttacataaattttaggaagaaaatgaagaacaagagccatacaaattctcatgtgtcctctatgaatggcttctcttgcaaccttagctgttgtacaacctaccgtcgttaaaggcctcggaggaagctccatcaccggaaccaagctttcggttaagactactgctcgtcgtagtctgagacaaactaaaatcaggactggtgccgtggttgccaaatacggtgacaaaagtgtgtacttcgacttggaagacatcggtaacactaccggacaatgggacttgtacggttctgatgcaccatctccctacaactctctccagagcaaattctttgagacatttgcagctccattcaccaagagaggtttgttgctcaagttcttgataattggaggaggttcaacacttgcatacttgagttcaacagtctcaggtgacatcttaccaatcaagaagggtcctcaattgcctcctaagatgggtccacgtggaaagatctaaatgctgaaaatggaaactcgacatcctttgtggttgagttacagtttatcttaattttcagaatttgtaactatgacattggtttataactagtcttgttttcgtgtgtacatcataaacgattcggttcgaaggcaatttaagatcattttatgataaaaaaaaaaa

SEQ ID NO: 412 - DNA, 592 bp, Artificial Sequence
  Synthetic
  misc_feature (366)..(366): N at this position can be a, c, t, or g.
aaggatagcagagagagagagagagagagccatggcaggattagcatcgacatcttccgccgtagcatgcggtgtgacctcgtcttctctctctggccagaagcttgctattgcgcactccaacctctctcttcccagggctagcccaagagcgggagtagctgtcgctaaatatggtgagaagagtatgtactttgaccttgaagatatcggtagcactaccggttcttgggacctctatggagccgatggaccttccccctataatggattgcagagcaagttctttgagacaactgcaggagcatttacccgtcgaggcattcttttgaagttcttggtcttgggtggaggcggcactcttgncctacgttagctccactgcaggaaaagttgtcctgcccatcaacaaaggacctcaggagccccctaaggttggaccccgaggcaagatctgagtattaactctatgtatcaaatctatctctcatgtggattccaaaagaactgataaatccagataagttggcttttctgtgtaattagtttttgttcctgttagttgtgaatgcaacaaattctatgaattggg

SEQ ID NO: 413 - DNA, 416 bp, Artificial Sequence; identical to SEQ ID NO: 300
  Synthetic

SEQ ID NO: 414 - DNA, 585 bp, Artificial Sequence
  Synthetic
atcatcatcatcatcatcgaagaagcaggaagctaaatggggaagagtacattcaagcaagagcatgacttagataagagaaaagcagaggctgcaagaattcgagaaaaataccctgatagaattccggtcattgtggagaaggctgagagaagtgacattccaaatattgataagaagaagtatcttgttccggctgatttgacagttggccagtttgtatacgtgatccgaaagcgaatcaaactcagtgctgaaaaagccatctttatctttgttgataatattctgccagctactgctgctattatgtcgaaaatctacgaggagcacaaggatgaagatgggtttttgtatgttacatacagtggagagaacacatttggggttaggtaactttcttgcatacctaatacctatgggtttatttctcatagctcaaaaatgatgacaatcgaagcatatccctgcttagagcaaataattgaaacataaatggtggcactcttctgtatatagtgtggaaatggtttggtacatctgaaccaagattgaaattaatggaactaattctcacgagtctta

SEQ ID NO: 415 - DNA, 462 bp, Artificial Sequence; identical to SEQ ID NO: 305
  Synthetic

SEQ ID NO: 416 - DNA, 510 bp, Artificial Sequence
  Synthetic
aagcgacgacgcgatcaatcaagcgcttgtttggaacttggagccaaccgaccatggccgccggcagcaccttcaagcaggaacatccactcgagaagaggcagaaggaagcggcaaagatcaaagagaagtatcccgacagagtacccgttattgtagagaaggcggctaagaccgacatggctgacatcgacaagaagaagttcttggttccagccgacttaaccgttggccagttcgtctatgtgatccggaagaggatcaaggtgggcgcagagaaggcaatctttgttttcgttaagaacacgctgccacccacggcgtctttgatttcaaccatctacgaggagcacaaagacgaggatggattcctctacttcacgtacagtggggagaacactttcggccaagacgttctctagacactgacttcacttctgtacaaagcaatttctttgttgatacgtttcctttgtggattgtgtaacttaaaacttatctaaatcttat

SEQ ID NO: 417 - DNA, 558 bp, Artificial Sequence
  Synthetic
cccacgcgtccgcctaattctgttttctacacgaaacccatcgaaatcgaattttgatcgtttctactttctgccatttgattctcttcatcagtcagatttagggaaaccgagaagccctaatctttgattctttaatcgccatggctaatagctctttcaagttggaacacccactagagaggagacaaattgaatcttctcgcatcagggagaagtatccagacagaattccagtgatcgtagagagagctgaaagaagtgatgttcccaatatcgacaagaagaagtaccttgttccggctgatctaactgtggggcagtttgtgtatgttgtccgtaaaagaatcaaactgagtgccgaaaaggcgatcttcgtctttgtgaagaacacattgcctccaactgctgcaatgatgtctgcaatctatgatgagaacaaagacgaagatgggtttctctacatgacttacagtggagagaacacctttggtttggtttaaatgtgtgcctttcaatgcttttgtgcttatgtgtatattatatgctcttttataa

SEQ ID NO: 418 - DNA, 474 bp, Artificial Sequence
  Synthetic
ggtctggttcctctttgccgcggccacagagggagagagatcgatcggatatgagtggcaagcaggtctcggctaagagctccttcaagcaagagcatgatctcgagaagaggaaggccgaggctgctacaattagggccaagtatccatagagaattccggtgattgtggacaaggctgaaaggagcgacatcccaaacatcgataagaacaagtatctagttccagccgatctgacggtcgggcagtttgtctacgtggttcgcaagcggatcaagctgagtgcggagaaggcgatcttcatcttcgtaaataacgttcttcccccgactgccggaatcatgtcggcaatctacgacgagcacaaagacgaggacggtttcctgtacgttacatacagtggggagaacacgtccgggctttgtctatgaagatgaagaagcagcgatgatccatccagcaaaattgcatcga

SEQ ID NO: 419 - DNA, 642 bp, Artificial Sequence
  Synthetic
  misc_feature (306)..(306): N at this position can be a, c, t, or g.
ttcactccatcatccccgctatcgatatttatcgcttttatcgccctctgaatcgccatcgatagtctcacagccgcacaacaaccaacccgctgcactttcactctcatcacccaacactcttaacctttcggttgccgtcaagatgcgcagcaagttcaaggacgagcaccccttcgagaagcgcaaggctgaggccgagcgcatccgacagaagtattccgatcgcattcccgtcatctgcgaaaaggtcgagaagagcgatattgctaccatcgacaagaagaagtacctagtccccgcggnacctgacagtaggccagtttgtctacgtcatccgcaagaggattaagctttctccagagaaggctatcttcatcttcgtggatgaggtccttcctcctactgccgctctcatgagcagcatctacgaggagcacaaggacgaggacggcttcctatacatcacctactccggcgagaacacctttggtaccgcataaacaccgaggcgatacaggggaactttccaagccgatgtggctgatgcaggcgttctggtcgttgggcttttactctttccgatgggggatactggtgctttgtgatattgcgaattcattgtttttatcaaacaagaag

SEQ ID NO: 420 - DNA, 644 bp, Artificial Sequence
  Synthetic
cgattcgccccccgcctcgatcgatcgattccgcgggagcgccccttcgatcggttggagatggccaggacttccttcaagctcgagcacccactggaaaggaggcaagcagaatctgccaggatccgtgagaagtactcagacagaattccggtgatcgttgagaaggctgacaagaccgatgttccagaaattgacaaaaagaagtaccttgtccctgctgatctcactgttggccagtttgtctatgtggttcggaagaggattaagcttagcccagaaaaggccatctttgtctttgtgaagaacacattgccgccaactgcttctttgatgtctgcaatctacgaagagaacaaggatgaggacggcttcctctacatgacttacagtggcgagaacacattcggctctgcgtaattcatcaactgttgctgctgctgtaaataaacatggatggccaggtgtcatggtcaacctcctgtgtacatagcatgtccctgtgctggattgcctcaatggtctaatgcgtccttagctttttaagtggttcgtatgctatcgtttgaaagttggaacgacccatagaactgatattattcattctgggttgatgacgtttcttattctaccattatgcattt

SEQ ID NO: 421 - DNA, 586 bp, Artificial Sequence
  Synthetic
aattgttcaatccaaaggggaaccagcacgcaagcaaccagcgaaccctagctacagagagattcgcatcaaggaagaagacgagagaggctcatttgaattagagatagagatgaagcccaggcccttcaaggaggagttcaccttggaggagagggccaaggagtcggccgccatgatcgcctcctaccccgacaggatccctgtcattgttgagaaattttcgaggagtaatcttccagaaatggagaagcgcaagtacctggttccatgtaacatgccagttgggcagtttattttcatacttcgttccaggctacatttgtctccagggacagcgttgtttgtgtttgtcaacaacactttgccccagactgctcagctgatgggcagtgtgtatgagtcatacaaagatgagggcgatggcttcctctacttgtgctacagcagcgagaagacattcggttgaccaactcctccgtggagatctgcttttacctcgggcatcaataatatatgcatgtatatatattactatgattagaaattacaattatgtgttttatatactgtatattgattgatg

SEQ ID NO: 422 - DNA, 456 bp, Artificial Sequence
  Synthetic
tgaagtcattatttctgttctttcaaaggcgctccctttttcttttgtaaaactagccaaattgatcacaaccactcttcaattcttcgattttcttctgttttgttaaagatcaaagtttgagtcttgtcatggccaagagttctttcaagcttgaacaccccatggagaggaggcaggcagagtcttctcgtatccgagagaagtatcctgatcgaattccggtgattgttgagaaggcagagaggagtgatatccctgacattgataagaagaaatacctcgtcccagctgatttgactgtcggacagtttgtttatgtggttcggaagaggatcaagctcagtgctgagaaggccatatttgtctttgtcaacaacactttgcctcctacggctgccctgttgtctgcaatatgtgaggaaaataaggatgaagatggatttctctacatga

SEQ ID NO: 423 - DNA, 476 bp, Artificial Sequence
  Synthetic
gattgtacttgaagatgcgtgtctgatgttcattatccaattatatagagtacactttatttttttttattaactttaataaacaagaaaaaatttggttgcttcttcactctcttgtgatttcctttgttttgcagataccccaaatttttggttatcattctccgatcaccatggccaaaagctccttcaaattggaacatcctcttgagaggcgacaggttgaagctgctcgtatcagggagaagtaccctgatagaatcccggttattgtggagaaggctgaaagaagtgacattcctgacattgacaagaaaaagtatttggtccccgcggatctgactgttggacaatttgtctatgttgttcgtaagaggattacgctcagtgctgagaaggcaatttttatctttgtgaagaatatcctcccccctacagctgcaatgatgtctgccatttatgaaggaacacaagga

SEQ ID NO: 424 - DNA, 567 bp, Artificial Sequence
  Synthetic
ttgtgaagcagggagatggggaaggctttcaaaaaagaattttcagacgatgagagactcgcagaatctcaagatataatcgccaaatatcctgatcgactgccggtggtggttgaaagatattcaaagactgaccttcctgagatggaaaagaagaagtacctggtaccccgtgatatgtccgttggccaatttatccacattctgagtggcagactccatctggctcctgggaaagctctcttcatgtttgtgaataacaccttgcctcaaacaacaagcttgatggagacggtgtatgattctttcaaggataaagatgggttcctctacatgtgctacagcagtgagaaaacctttggtcgtgcaaatagttgagcatattgtcattcctaggaagtgcaacacattgtgaactaaaatatgtaaatggtatctgtattgcatgtccggcatacctgtaaattcttgcactagggtgtctatactctcaactgtatatctgaaggaaattcaaatgttattctatcgtcccttggaaagaataaagaatacaaaggttgcagt

SEQ ID NO: 425 - DNA, 673 bp, Artificial Sequence
  Synthetic
gggagaagaagaaggagaagccatgggtaggagcttccagttcaaacaggatttcccctttgagacgagggtcgaggaatcggccaaaatgaggcataaataccccgaccgagtacccgtcattgtcgagaaagcgggaagaacagatttgctggatcttgaaaagaaaaagtaccttgttccagaggaccttacagtcggggaatttgtttatgtgatcagacggcgtctacaattaagtccgggacaggctctgtttttctttgtcaatgatattcttccgccaaacgctagtttgatgtcttcagtgtacaagaatcagaaagataaggatggattcttgtatatcaactacagtggggagaagactttcggctctatggaccttccaggtgtccgcccttcataaccttcttctattgtgttcacgtcctgctacatcttgtatataaactttgtatataatgccaaagcttctcaacaaatggaaatttggccaattcgacatagtatactttataaccaatatatttcatgataaatatattatatgattaatatataacatgataaacatataacatggcagatatattacatatcaaatatattacacaataaatatattacggagttaatatattgcataatataaatatatctcctgccagtt

SEQ ID NO: 426 - DNA, 433 bp, Artificial Sequence
  Synthetic
caaacttatttgttgtatctaaatatattacaaagtttcaacccaaatttacaatcttctctggagagatacttcataaagcaaaaaccataaagttctaatcaagagaatctcactctacttaattaacaaagatcttttttaaaacatccttccaagctttgtgatgagtatgcttcttcaagacttttgattctgctgtttcttgtttttaaagttttaataagttcctcttttaagttggttcttgtggacgagctgcccaaagagaactaagagcacgaagtctatgaagatactctcctaaagctagtaaacctcgagccgattgtcttgtcgttaagatcttcgccatttgttgcaaagtttgttgcctcagatgatctgcttgattcacaaatccttctaatgcttgaagattctctatagctgc

SEQ ID NO: 427 - DNA, 405 bp, Artificial Sequence
  Synthetic
caatttacagccatgtttaggaggaaggctttcttgcactggtacactggagaaggaatggatgagatggaattcactgaggcggagagtaacatgaatgatctggtctcagagtaccagcagtaccaagatgcagtagctgatgaggatgaaggatatgaggacgaagaagaagcatatcatgagtagtgagctaataatgatgggaaatctcatcttatattttaagcaatagttctttcaactgtggatgtaacctcaactaccatacccataggaggagatgaacttcagtagtgaagagaaagcgactaacctgtatttttgttgaacttgtcactatcctttaattgcaaattgaatattttgttgcttatgctaagatatctgtgattggttgatgag

SEQ ID NO: 428 - DNA, 852 bp, Artificial Sequence
  Synthetic
ccctgaaccacttgatcagtgctacaatgagtggagttacttgctgccttcgcttccctggtcaattgaactctgacctccgcaagctggccgtgaacttgatccctttccctcgcctgcacttcttcatggtgggctttgcgccactcacctcgcgtggctcgcagcagtatcgcgccctcactgtccctgagctcacccagcaaatgtgggacgccaagaacatgatgtgtgccgctgacccgcgccatggccgctacctcacggcctccgccatgttccgtggcaagatgagcaccaaggaggtggacgagcagatgatcaacgtccagaacaagaactcgtcctacttcgtcgagtggatccccaacaacgtgaagtccagcgtgtgcgacatcccgccgcgcggcctctccatggcgtccaccttcatcggcaactccacctccatccaggagatgttccgccgcgtgagcgagcagttcaccgccatgttcaggaggaaggccttcttgcattggtacaccggcgagggcatggacgagatggagttcaccgaggcggagagcaacatgaacgacctcgtctccgagtaccagcagtatcaggacgccaccgccgacgaggccgagtacgaggaagaagaggacgcgatacaggagtagagactgtctgggcaatggtacctcgtatcccctgcccatcgttaccctaatatgtttgcctgaacatcatcgcagttgcatcaccatagctacctccgcaccttaaaatttgatgcttgtttgtatgcatgtttgtactggttccgtatgctaaagtcttggctattgatgttctgtttgcttgctt

SEQ ID NO: 429 - DNA, 852 bp, Artificial Sequence
  Synthetic
cccacgcgtccggcttaactctgaccttaggaaactcgctgtgaaccttatcccattcccaaggcttcacttcttcatggttggtttcgcaccattgacatcgagaggatcacagcaatacagtgccttgagtgttcctgaactgacccagcagatgtgggatgcaaagaacatgatgtgtgctgctgacccccgccatgggcgctacctcacagcctcagccatgttccgcggaaagatgagcaccaaggaagttgatgagcagatgctgaatgtccagaacaagaactcgtcatactttgtggagtggatccctaacaatgtcaagtcgagtgtgtgtgacattccacccattggcctgaagatggcatccacattcatcggcaactcgacctcaatccaggagatgttccgccgtgtcagtgagcagttcaccgccatgttcaggaggaaggctttcttgcactggtacactggtgagggaatggacgagatggagttcaccgaggctgagagcaacatgaacgacctggtagctgaataccagcagtaccaggatgccaccgctgaggaagaggactatgaggaggaagaggaggacgaggaggttgctgcctaagccacctctctgcatgtttgagctatatagatatcccttgtgacatttgctactactagttaccatcgttgattgggggtgcttgttagatgctaggttaatgttattatttccaaatactatgttgccttgtcggactatttttatctgggttaatggtatgttccacattattgtcttgaggtggattaactgttggaagtatgtagcaaagcttgaggtggaaaaaaaaa

SEQ ID NO: 430 - DNA, 1135 bp, Artificial Sequence
  Synthetic
catgtgcttgaaaatagttttaaattttaatctcataaagctatattgttcaattataataattcaaaataaaaaagcagtgttttttagtatgagggaaatgtatcatggaatgaaaaagcattaagtataaaaaaataatggattaatatacagaattttttttaaaataaaaagtaacaaaaaatgacattttaaagctaattgtttaaaaaaagtctagttttcatcaacttcttgttcttgttcttcatcaaattcagcttcctcatcagcggtagcttcttggtattgttggtattcagatactaaatcattcatgttggattcggcttcagtgaattccatctcatccataccttcaccagtataccaatgcaagaaagccttacgcctgaacatagcagtgaattgttcactgattctcttgaacaactcttggatagctgtagagttaccaataaatgtagcagacattttaagacctcttggaggaatatcacacactgcagttttaacattgttgggaatccattcaacgaagtagctcgaatttttgttctgaatatttaacatttgttcatcaacttctttcatggacatacggccacggaatacagctgctactgttagataacgtccatgtcttgggtcacatgctgccatcatgtttttggcatcaaacatttgttgggtaagttcgggaacggttagtgccctgtattgttggcttccacgagaagtaagaggagcgaaaccaggcatgaagaaatgtaacctggggaaaggaaccatgttgacggcgagtttacggagatcagcattcaattgaccagggaacctgagacaagtggtcactccagacatagtcaaagagactaagtggtttaagtcaccgtatgttggtgttgtaagttttaatgtacggaagcaaatgtcatacaaggcttcgttgtcaatacagtaggtttcatcagtattttctaccaattggtgaactgaaagggtagcattgtagggttctacaacagtatctgacacttttggagagggtacaacagaatatgtgttcattattctgtctgggtattcttcacggattttggagatcaataaggttccccggacgcgtggg

SEQ ID NO: 431 - DNA, 773 bp, Artificial Sequence
  Synthetic
aaccacttgatttctgctacaatgagtggggtcacttgctgcctcaggttcccgggtcaattgaactctgatcttcggaagcttgctgttaacctgatccccttccctcgtttacacttcttcatggttgggtttgctcctctcacttctcgtggttcacagcaataccgtgcactaacagtcccggagctgactcagcaaatgtgggatgccaaaaacatgatgtgtgctgctgatccacgccatggtcgttacctcactgcctcagccatgttcaggggtaaaatgagcactaaggaagtcgatgagcagatgattaatgttcagaacaagaactcttcttactttgttgaatggattccaaacaatgtgaaatccagtgtctgtgacatcccacccagaggtctctcaatggcatccaccttcattggaaactcaacttccattcaggaaatgtttaggagggtgagcgagcagtttactgctatgttcaggagaaaggctttcttgcattggtacacaggggaaggaatggacgaaatggagttcacagaagctgaaagcaacatgaacgaccttgtgtctgagtatcagcaatatcaggatgccactgctgatgacgaaggtgaatacgaggaggaagagtacgatcatgaaggcaactgaagaaagacattttattatatgtggtgtaatacgtttctgatctcccagagatatgagcagtttttttcttgtatgttgcatctttgcgtacactttgctgtgaagtc

SEQ ID NO: 432 - DNA, 610 bp, Artificial Sequence
  Synthetic
caagctgaccacacctagctttggggatttgaaccatttgattgctgccaccatgagtggagtcacatgctgcctaaggttccctggtcagttgaactctgacctccgtaagctggcagtgaaccttatcccctttccccgtctccacttcttcatggtcggattcgccccgctgacatcacgtggctcccagcagtaccgtgcccttactgttcctgagctcacacagcagatgtgggatgccaagaacatgatgtgcgctgctgatcctcgccatggccgttacctcaccgcctctgccatgttccgtggaaagatgagcaccaaggaggttgatgagcagatgatcaatgtccagaacaagaactcatcctacttcgtcgagtggatccccaacaatgtgaagtccagtgtctgtgacattccaccgagaggcctctccatggcatcgaccttcattggcaactcaacatccatccaggagatgttccggagggtgagcgagcagttcactgctatgttcaggaggaaggctttcttgcactggtacactggcgaaggcatggacgagatggagttcaccgaggcagagagcaacatgaacgacctt

SEQ ID NO: 433 - DNA, 891 bp, Artificial Sequence
  Synthetic
ttatatgatatttgtttcaggactttgaagctcactactccaagttggggtgacttgaaccatttgatctctgcaaccatgagtggtgttacttgctgtttgagattccctggtcagctgaactcagacctgagaaagttggctgtgaatttaattcccttcccacgtcttcatttcttcatggtgggctttgcaccattgacctctcgcggatcgcagcaatacatttccctcacagtgccagagcttactcaacaaatgtgggatgcaaagaatatgatgtgtgctgcagatccccgtcatggacgctacctgacagcttctgcaatgtttaggggaaagatgagcacaaaggaagtggacgaacaaatgatcaatgtgcagaacaagaactcatcctactttgttgaatggatccctaacaatgtgaagtctagtgtatgtgatatcccaccaactgggcttaagatggcatccacatttgttggcaattcgacctccattcaggagatgtttaggagagtgagtgagcagttcacagctatgttcaggcgcaaggcgtttttgcattggtatacaggtgaaggtatggatgaaatggagttcactgaagccgagagcaacatgaatgatttggttgcagaatatcaacaataccaggatgctacagcagatgatgaggaagagtatgaagaggagggcgctgaggagcattatgaatcttaaagacttctctaaattcaatattgctgcttttgtcaaatttctgccaagtggacttgttattgtttctattgtcttctttgcacttgaactttctgttttgatttggtgagaattgaatattgaaatgtttcttaatggtctaattatgagcaatactgtattact

SEQ ID NO: 434 - DNA, 590 bp, Artificial Sequence; identical to SEQ ID NO: 304
  Synthetic

SEQ ID NO: 435 - DNA, 691 bp, Artificial Sequence; identical to SEQ ID NO: 306
  Synthetic

SEQ ID NO: 436 - DNA, 608 bp, Artificial Sequence
  Synthetic
cccacgcgtccgctcggtgaggctgtcggtgttgaagggctggttgtcggtctgcgcgctcagcgccagcagcgcgcgccgcgagaagcaggtaccgacaccggccgacggcaccatgccggaaacactttcgcgcaccaccagatccttggcatgccattcggcgaactcgtccatgtagacgccggccaccagttcgtaccactcgcggtccagcgaggtgaccggcaactggatcatgtccttgcgcggcaaaaggtagttgtagaagcgcagttccatcgggtgcagcacgtcctcgctgtcgtgcaggatcaccccggcgaactcgatgtcgtggcgcttctcgtaatcgaagatggccaggatcagccagttcaggcagtcggccttgctggtcggcccgtcatgcggcacttccacgcggcgcaggcgcttgtagcggcggcgcatgcgctccacttcgtcgatggtctgctggtcgttgggataggtgccgacgaacacgacgtactcgcggtaatcgagtacgttgatcatgttctccaccatctgcgcgatgacgtcgtactccatccacgccggcaccatgatcgccagcggctgtt

SEQ ID NO: 437 - DNA, 341 bp, Artificial Sequence; identical to SEQ ID NO: 196
  Synthetic

SEQ ID NO: 438 - DNA, 669 bp, Artificial Sequence
  Synthetic
atagaaaaatctcaacatttcaattggggaaaatgggttctctacattcatacactgctgttcatcggaaagaaacaaggaaagaaaacgacggttaaaactgaagaccgtgttcacgtgctgcagcagcaagagcctcaatacgtccatggtaagggtaaccaccacggtcaaaggctacctttgtgatacctttctccaagcaagattttgctatcacttccccaactttcttcgctacctcaatggttggtccagaggtgtagtcgaactcttcagagattggtttctgcttagtggaagctgaagctaaggtgtgcatcttggtatcatcaatcacttgaacataaagatgcttgtttgatcggaaaacacatagccttggcctctccgttgtaccattaaccttcttacggatacgagagtggcgggcgattctgtcttcgctgctggttttggttttggcttcgacaaccatggaccgagactgaagcgaagaagacgaccatggtttaaggaaaacggcacggtgttgaagtccgtttcccaagaacgcactgcggttagttatcagactcactgaaccacacccactcacgctcgtcattctctcttactcactctctctggctcgctctctgttcgtaaaagcctagttctagatcgcga

SEQ ID NO: 439 - DNA, 627 bp, Artificial Sequence
  Synthetic
  misc_feature (581)..(581): N at this position can be a, c, t, or g.
ggcgaaccaaaaaagccatggcttgtacttcactttcactttcttttcttcacaacgcttgcgccgataacaagcagctgactcttccattccgtaccaaattggtgacgtcagctcggcctcttacagttgaagccaaggccacaacgagacgggaagacagaactgcccgacatgttcgtattcggaagaaggttgaagggacacctgaaagaccaagattgtgtgtcttccgttccaacaagcacatctatgttcaagtaattgatgactccaagatgcacacactggcatctgcttcaacaatgcagaaaccaatcgctgaggaattcgactactccgctggccccactacagacgtggcgaagaaagttggggaggttatagctaaggcctgtctagagaaaggaatcactaaagtagccttcgaccgaggaggttatccttaccatggacggattgaagctctcgctgatgctgcaagagaacacggccttcagttttagaaagtgcagatttctttcttcttcttttttgttgtgcaaattaccttttctgatcttcccattggttcccagttngtaaaactcatgtctaagaagtaagatgaactggagtttaaatgta

SEQ ID NO: 440 - DNA, 608 bp, Artificial Sequence
  Synthetic
taacatttcaaagcagaaaaccctacaagtccgaaagttctctgaatttttcaaatttctcaatggcacgtaccaagcaaactgctcgtaagtccactggtggcaaagcaccaaggaagcaactcgccacaaaagctgctcggaaatcagctccggcgaccggtggagtgaagaagccacacagattcaggcctggaactgttgcgcttcgtgaaatcagaaagtaccagaaatcaactgagctcctgatccgtaaacttccgttccagcgtttggttcgtgagatagctcaggattttaagaccgatctgaggttccagagctctgctgttgcagctcttcaagaggcggctgaagcataccttgttggtttgtttgaggacactaacctttgtgctatccacgctaagagggttaccattatgcctaaagacattcagcttgccagaagaattaggggcgagagagcttaaattagtttttgggtgtatagtggattgtttgttaagggttttgagccttttgtgttttggtgtagtactttctcagttctggctatgtagttcaatgaagtgcattttaatgaaatatcagtactattttatcca

SEQ ID NO: 441 - DNA, 625 bp, Artificial Sequence
  Synthetic
tacaatcagagcatttctcaatctacaaaatggcccgtactaagcaaacagctcgcaaatcaacaggtggaaaggctccaaggaagcagttagctaccaaggcagcgagaaagtcagctccggcgaccggaggagtgaagaagcctcaccgtttccgtccgggaactgtggctttgagagaaatcaggaagtatcagaaatcaacagagttgttgataaggaagttgcctttccagaggctggtgagggaaatagcacaggatttcaagacagatctgaggttccaaagcagtgctgttgctgccctgcaagaggctgctgaggcttaccttgttggactctttgaagatacaaatctctgtgccattcacgccaagagggtcactatcatgccaaaggacattcagcttgctaggaggattcgcggcgaaagggcttagaatgaagcttgttatgcttatggttatggttaattgtcttctctgatcttgggcatcgttttagtgtcttttgctgaatattagggttagcgatgtaaatcaagtgacttgtttcaatcaaagtatatgtaaaacctctaattagtactttgaattcttattaatgaaatttgtcgttcattttg

SEQ ID NO: 442 - DNA, 668 bp, Artificial Sequence
  Synthetic
gccattacggccgggggacagaacaaaagaagagaagaaggagaaaaagaaaagatttaatacgagatggctcgtaccaagcaaactgctcgtaagtctacaggaggaaaggctccaaggaagcaacttgctactaaggctgcacgcaagtccgctcctaccactggcggtgtgaagaagccacatagataccgccctggtactgttgctcttcgtgaaatccgtaggtaccagaagagtactgagctcttgatcaggaagcttccatttcagaggcttgttcgtgaaattgcccaggactttaagactgatctgcgtttccagagtcatgcggtgctggctctgcaggaggctgctgaggcctacttggtgggtctctttgaggacactaacctttgtgccattcatgccaagcgtgtgacaattatgcctaaggacattcagcttgccaggcgaatcaggggcgagcgtgcttaatttgatctactagcttgtagcgttggtgtgatccttgtctttcttttctttgtaagacgtaaagacagtaactaaatctagtagtagggcttgttgcttttaatttgctggtggctggtggtgtgctgtaatttcttggtgttttcttttggagaagggggaaaacatgctattttgtttggatctctaat

SEQ ID NO: 443 - DNA, 623 bp, Artificial Sequence
  Synthetic
cccacgcgtccgcaaacactcatatattctttcatccaaatcctttgagccctaattcccaaatggctcgtacaaagcaaactgcccgaaaatccaccggagggaaagctccgagaaagcaattagccacaaaagctgccagaaagtcagctccggccaccgggggagtgaagaagcctcacagattcaggccagggactgttgcgcttcgtgaaatccgcaagtaccagaaatcaactgagcttttgatccgtaagctcccgttccagcgtttggttcgggagatagctcaggacttcaagaccgatctccgtttccagagttcggctgtggctgcgctccaggaagctgctgaggcttatctcgtcggtttgtttgaggacacaaacttgtgtgctattcatgctaagagggttactattatgcctaaggatattcagcttgctaggagaattaggggtgagagggcataagtgtgaacctacggtagctatgggagcttgtaactgagcatatggtagatgagtttctaggcttttactgtattttggtccaaaattttctcaattctggatatgtagtcgtattaaaagtattttaatgaaatatcagttcttctttgc

SEQ ID NO: 444 - DNA, 553 bp, Artificial Sequence
  Synthetic
cccacgcgtccgcttcatcaaatctcacaaatcttcaacacttaatcacaaatctcaaagcttcggataccaaatggctcgtaccaagcaaaccgcaaggaaatccaccggaggaaaagccccaaggaaacaactcgcaacaaaggcggcgaggaaatcagctccggcgaccggaggagtaaagaagccacacagattccgtcctggaactgttgccctaagagaaatcaggaagtatcagaagagcactgagcttctgatcccgtaagctaccgttccagcgcttggttcatgagatcgcttcaggatttcagaacaaatctgcatttccagagcaacgccgtttgcagcacttcacgtaagcggctgaagcataccttgttggattgtttgaagacaccaatctttgcgcgattcatgctaatagagtcactatcatgcctaaggatattcaattggcgaggagaattagaggcgagagggcttaagaaggagattgaagtactctatactgtgatcgctatgcttatgtatatctttcgttttccctaat

SEQ ID NO: 445 - DNA, 307 bp, Artificial Sequence
  Synthetic
cccacgcgtccgcaagaagaaaattcgatcggtcgattagtctttgtttgatttcgaaatggctcgtactaagcaaaccgcgaggaaatccacaggaggcaaagcaccaagaaagcaactcgcaaccaaggcggcaaggaaatctgctccggccaccggaggagtgaagaagccgcatagattccgtccaggaactgttgccttgagagagatcaggaagtatcagaagagcactgagcttctgatccgtaagcttcctttccagcgtctggttcgtgagatagctcaggatttcaagacggatctg

SEQ ID NO: 446 - DNA, 303 bp, Artificial Sequence
  Synthetic
cccacgcgtccgcaaaactcgcttcctgataatcaaatcaaaagcttctctatcaagcttatcgaaaagtcacatcttttggaagaaacaatggctcgtaccaagcaaaccgctaggaaatccaccggaggtaaagctcccaggaagcagcttgccaccaaggcggcgaggaaatcagcaccaaccaccggaggagtcaagaagcctcaccgttaccgtccaggaaccgtcgctcttcgtgagattcgtaagtaccagaagagtactgaattgttgatccgcaagcttcccttccagcgtctc

SEQ ID NO: 447 - DNA, 577 bp, Artificial Sequence
  Synthetic
tttgcttggaattaatattataacccttggatttaacttgaaattttacaatcttatggttctaatcaaaacacaagagtaaccagaatacttagatctaagctcgttctcctctgattcttctcgcgagctggatgtccttgggcatgatcgtgaccctcttggcgtgaatggcgcagagattggtgtcttcgaagagtccgacgaggtaagcttcagcagcttcctgaagagcggcgacggcactgctctggaaacgaagatcggttttgaagtcctgagcgatctctctgacaagcctctggaaagggagtttacggataagaagctcagtgctcttctggtacttcctgatttctcttaaagcaacagttccgggtctgaatctgtgtggcttcttcactcctccggtggccggagcagatttcctcgccgcttttgtcgccagctgcttccttggagcctttcctccggttgatttcctagccgtctgcttggtacgagccatgaggtaaaatgttattaagaaactgtttgattttaatttgaagatgagagaaagttgcggacgcgtggg

SEQ ID NO: 448 - DNA, 1105 bp, Artificial Sequence
  Synthetic
tgcttttggccacagacctactcacgattggcagttgatcacaagcctcttccgcaatggagcatggcattccacaactgtgtccaacgattccattcagggcgcatttttgcggttccaatagatacttcttgtaaagttccaatctcttatttcttgtttcagaatatacatgctttcgctcacatctcttaccacagtaagtacttgtagttaaggtaccacaacacacacaagagaaagtagccattctagacctaggaccagggttagattccacgtcacccgccaacttcagcaaatcaaaattcaacagctgtttgtagagctcggcataatccggaacatcatacggataagcggccgcaccgcgctcaccacggaggcggcgggccagctggatgtccttggactggatggtgacacgcttggcgtggatggcgcaaaggttggtgtcctcgaagagggagacgaggtaggcctcaacggactcctggagagcgccgatggcagaggactggaagcggagatccgacttgaagtcctgagcgatctcacggacaagacgctggaagggcagcttgcggatgagaagctcggtagacttctggtaacgacggatctcacggagagcgacggtaccaggcttgtacctgtggggcttcttgacaccgccggttgagggggcggacttgcgagcagccttggaggcgagctgcttacggggagccttgccaccagtggacttacgggcggtctgcttagtgcgagccatgcttaattaatgcgaaggtaaatacagtagatttaaacatcaggacctagagttcaccactcgaagtcttttctcagcttcttatccacaaatttcccttcacaattaaacagcaacttaaacttattaaagtcaaagatatgataacataaagaaaccaaagcagaaatagcactataaggggatcgatatctatccactaaagccttatccaaagcatcaagcaccttaaagtctttgtaagatttgtaattgtcattgatagagatataaatctcactcaaaacttctacatctctcacatcagttctacctaattttgtgataaat

SEQ ID NO: 449 - DNA, 513 bp, Artificial Sequence
  Synthetic
attctctctctctagaaactgtactctttctttctctagaagatctgaagcaatggcaagaacaaagcaaacagcccgaaaatccacaggaggaaaggcaccaaggaagcaattagccacaaaagccgcaaggaaatcagcaccagcaacaggaggagtgaagaagcctcaccgtttccgccctggtacagtggctcttcgtgagatccgaaagtaccagaagagcactgagcttttaatccgaaaattaccttttcaaagactggtcagagaaattgcacaggatttcaagacggatcttaggttccagagcagtgctgtagctgcactacaagaagctgctgaggcttacttggtgggtctctttgaggatacaaatctgtgtgctattcacgctaaaagggtgactattatgcctaaggatattcagttggctaggcgtattaggggtgaaagggcttaatgtttcattgttgtgttttttgtgtttagggttatggtgaatgtggtatg

SEQ ID NO: 450 - DNA, 585 bp, Artificial Sequence
  Synthetic
acttgacttagggttcttcgcgctagggttcttcgatcgtcttctcttcgaaccggccatggcgcgtaccaagcagaccgctcgcaaatccacgggaggcaaggcgcccaggaagcagctcgcaaccaaggctgccaggaaatccgctcccaccaccggaggagtgaagaagccccatcgctaccgcccaggaacagtcgctcttcgtgaaattcgcaagtaccagaagagcactgagctcctcatccgaaagcttcccttccagaggcttgttcgcgagatcgctcaggacttcaagaccgatttgaggttccagagccatgcggtgctggccctccaggaggcggcggaggcgtacctggtgggactgttcgaggacaccaatctgtgcgcgattcatgccaagagggtgaccatcatgcccaaggacatccaattggctcgccggatccgtggagagagggcttaagagattcatcaatcttaagaaaactagcttcaccaatgtagatactactactactactactaatccctctgtttgatttgatttcagtgcaaatgcaaagtcttctggttgtttgt

SEQ ID NO: 451 - DNA, 450 bp, Artificial Sequence
  Synthetic
ggaaagatttcgtcgcgctagggttttctgattcgtcgtccatggcgcgtactaagcagactgctcgcaagtccacgggaggcaaggcgccgaggaagcagctcgcgaccaaggccgccaggaagtcggctcccaccaccggtggagtgaaaaagccccatcggtaccgcccgggaacagtcgctcttcgtgaaatccgcaagtaccagaagagtaccgagctgctcatccgcaagctgcccttccagaggcttgtgcgtgagattgctcaggacttcaagacggatctgaggttccagagccacgcggtgctggcgctgcaggaggcggcggaggcatacctggtgggtcttttcgaggacacgaacttgtgcgcgatccatgccaagcgggtgaccatcatgcccaaggacatccagttggctcgccgcattcgtggagagagggcgt

SEQ ID NO: 452 - DNA, 691 bp, Artificial Sequence
  Synthetic
  misc_feature (454)..(454): N at this position can be a, c, t, or g.
  misc_feature (531)..(531): N at this position can be a, c, t, or g.
accaagtcttttttcaagcatcttcacagtcaacacatcacaacaactcatcatggcccgcaccaagcagaccgcccgtaagtccactggtggcaaggctccccgcaagcagctcgcttccaaggctgcccgcaagagcgctccctccaccggaggtgtcaagaagcctcaccgttataagcctggtaccgtcgctctccgtgagattcgacgataccagaagtcgactgagctcctgatccgcaagctccccttccagcgtctggtccgtgaaatcgctcaggacttcaagagcgatctccgcttccagtcttctgccatcggcgccctccaggagtccgtcgagtcttacctcgtctccctcttcgaggacaccaacctttgcgccatccacgcaaagcgtgtcaccatccagagcaaggacatccagctcgcccgccgcctccgtggtgangcgcaactaagttggagagactttgggaggaacgttgcagacatgacttttgcttttcacacgagtgtttctggggntcaagggataatcaggcgttacaaatgagagtttttattcccctttatggttcggaatgtatattaccagtgcgtcagggaaaaagcactgcataaatgcaaacgaggttcacggcctcacgggttaacgaactataataactgcatcactctaaaaaaa

SEQ ID NO: 453 - DNA, 581 bp, Artificial Sequence
  Synthetic
caaatccaaagaaatcactcgccgccgccgcctcgccttctccgccgcgccaagctctcctctcctcctcctcgatggcccgcacgaagcagacggcgcgcaagtccaccggcgggaaggcgccgaggaagcagctggcgaccaaggcggcgcgcaagtcggccccggccaccggcggcgtgaagaagccccaccgcttcaggcccggcaccgtcgcgctccgtgagatccgcaagtaccagaagagcacggagctgctcatccgcaagctccccttccagcgcctcgtccgcgagatcgcccaggacttcaagaccgacctccgcttccagagctccgccgtcgccgcgctgcaggaggccgccgaggcgtacctcgtcgggctgttcgaggacaccaacctgtgtgccatccacgccaagcgcgtcaccatcatgcccaaggacatccagctcgcgcgccggatccgcggcgagcgcgcttaggcgatccgccctcctttggttcttgcttggttcgtagggacttgtcatgttctaccagttcttgttaattattagatccttgccttgtcatgtcgt

SEQ ID NO: 454 - DNA, 718 bp, Artificial Sequence
  Synthetic
cccccccactgttcgcctttccacgccagtttggtcgctctcgatttcgatttcccccaaatccaccgcaagagccaagtcgccgccgagaagcgaagaggagatggcccgtacgaagcagaccgcccgcaagtccaccggcggcaaggccccgaggaagcagctcgccaccaaggcggcgaggaagtctgctccgaccaccggcggcgtgaagaagccccaccgctacaggccggggacggtggcgctccgcgagatccgcaagtaccagaagagcacggagctcctgatccgcaagctccccttccagcgcctcgtccgcgagatcgcgcaggacttcaagaccgacctccgcttccagagccacgcggtgctcgccctccaggaggccgccgaggcctacctcgtcggtctcttcgaggacaccaacctctgcgccatccacgccaagcgcgtcaccatcatgcccaaggacatccagctcgcccgccgcatccgcggcgagcgcgcgtaagccgccgccttcgacgcggttgcgttgcgtagcgccgaagcgatctggggggatcaacgacgacgacgtgacgtggtcaacttgttgattcccctctcgcttccgcgttttagatctcgttttcattagcagctttgtaatagggtttggtcggttaattagtgtaaaaacagggttcggttaaagactcaaaatcaaatgtta

SEQ ID NO: 455 - DNA, 699 bp, Artificial Sequence
  Synthetic
  misc_feature (65)..(65): N at this position can be a, c, t, or g.
cccacgcgtccgcacaaaagcagatagaagaaagaagaaggagaaaagaaaaaagagaagatggnctcgtaccaagcaaactgctcgtaagtctaccggaggaaaggcacctaggaagcaacttgctactaaggctgctcgtaagtctgctcctactactggtggagtaaagaaacctcacagataccgccctggtactgttgctcttcgtgaaatccgtaagtaccagaagagtactgagctcctgatcaggaagctcccattccagaggcttgttcgtgaaattgctcaggatttcaagactgatctgcgtttccagagtcatgctgtgttggctcttcaggaggctgctgaggcatacttggttggtctctttgaggacacaaatctttgtgccattcatgccaagcgagtcaccattatgccaaaggacattcagcttgctaggcgtatcaggggcgagcgtgcttaatttgataaagtgtggtagctttgttggtgcttttagatctttttgttaaaagactgatggtattaaaatttagtagtagggatgatatgctatgttgatcttatagtgtggtggatggaggtggtgaaacatagtatatgttggatctttctaatgttttgttgtcacaccgctggtgttgaacaagtttcagaatttgcatctaatgtttagttcaactctatggt

SEQ ID NO: 456 - DNA, 669 bp, Artificial Sequence
  Synthetic
ttcctcttctccttctgtagtttcctctctaatttcaaggtttcctcacacccttcaaactcgagcaatcttaaggaactcagatggctcgtacgaagcaaacggctcgtaaatctactggaggcaaggctccaaggaagcagcttgcaaccaaggctgcccgtaagtctgccccaacaacaggaggagttaagaagcctcacagatacagacctggaaccgttgctcttcgtgaaattcgcaagtaccagaagagtactgagctgttgatcaggaaattgccattccaaaggcttgttcgtgaaattgcacaggacttcaagactgatttgcgtttccagagtcacgctgtattggctttgcaagaagcagctgaggcctaccttgttggattgtttgaggacacaaatctgtgcgccattcacgccaagcgtgtcactatcatgcccaaggatatccagttggcccgaagaattaggggagaaagagcttagaatgatctgttctgccgtatcgtgcttagattgttgattttttttttgaattgccgtctttctgcatttttcttcttctttgttcttcatataggtagtttttactagatatgaatggctgtggcatactggaaatttgatactctctattatatagtcgaattttattggtatt

SEQ ID NO: 457 - DNA, 656 bp, Artificial Sequence
  Synthetic
cccacgcgtccgcaaagtctttcacattatcataatatattcgaaatggctcgtaccaagcaaactgcccgcaaatccactggtggaaaggctccaaggaagcagctagctaccaaggccgcgagaaagtcagctccagcgaccggaggagtgaagaagcctcaccgtttccgtccaggaactgttgctctcagggaaatcaggaagtaccagaagtccactgaattgttgataaggaagctgccatttcagaggctggtgagggaaatagcacaagatttcaagacagatctgaggttccaaagcagtgctgttgctgctcttcaagaggctgctgaggcttaccttgtcggactctttgaagataccaatctctgtgctattcacgcgaaaagggtcaccataatgccaaaggacattcagcttgctaggaggattcgtggagaaagggcctagaatgatgctatgttaatcttatggttattgttaattttgtgttcttctgatttagggctgcttttttctgtcgttcgtggaatgttagggctagtgatgtaaatcaaatgacttgtttccgtcaaactatatgtaaaacctctggtttaccagtattctaagatttgatcaatgaaatctacgttcatttcctttcaatc

SEQ ID NO: 458 - DNA, 673 bp, Artificial Sequence
  Synthetic
accacgcgtcgctttttcttctatctttgccatcctcgttctggttttggtagacagacaagaatggctcggacaaagcagaccgctcgtaagtcgaccggggggaaggcgccccggaagcagttggccaccaaggcagctcgcaagagtgcccctgccacaggtggagtgaagaagccccacaggttcaggcctggaactgttgcccttcgtgagattcgcaaataccagaagagtactgatctcttgatccgaaagctccccttccaacgcttggttcgtgagatagctcaagacttcaagactgatctccgattccaaagctctgctgtcttggccctgcaggaggctgctgaagcatacctagtgggtctctttgaagacacaaatctctgcgctattcacgccaagagagtgacaatcatgcctaaggatattcagctggccaggagaatcaggggggagcgtgcctaagtaaatattcctgaccttaccttcttaacggtgtatttgtacaccacattttgcctttgaaagttacattttggtctagtaatctatttctctgtttcagtgggcattactagtgatgcctaggctgatgggatgatcacttagtgatgataaccttggtacattttgattcatgttgtaagtttagagcatccgattt

SEQ ID NO: 459 - DNA, 656 bp, Artificial Sequence
  Synthetic
ataattttggcggggtttggaactgcgatttggaattcctcctgcacttcgacgacttctgatttcctgcgatggctcgtaccaagcagacagctcgtaagtctactggtggaaaggcacccaggaagcagcttgctactaaggctgcaaggaaatctgctcccactactggcggagtaaagaagccccacagatacaggcctggaactgttgctcttagagagatccgcaagtaccagaaaagcacagagttgctgattaggaagcttcctttccagaggcttgttcgtgagattgcccaagattttaagactgatttgcggtttcaaagccatgctgtgctggcattgcaagaggcagcagaggcatacctggttggactcttcgaggacaccaacctctgtgccatccatgcgaagagggtcaccattatgcctaaagatatccagcttgccaggaggatccgtggggagagagcttaacccgtcttttgctgaaagaactgtagttattttagttatttaattgttgtcatcttgtcttgtgctcgaagtaactgccttgttactttgctgttgggctcgttcccaagaaacttgtggtcttattggccaattgtactagcttaatatacactgcttgtttttgaacaatgt

SEQ ID NO: 460 - DNA, 688 bp, Artificial Sequence
  Synthetic
agtaaaacaccacatcccaagtcaatacacattaacccagccatacaaacgactccaaaacaccaaccaaaatcacaactttcacagcattctcgaccttctcccctcttgcaaaaaatcctttaaaaatggcaagaacaaaacaaacagcacgtaaatccactggaggaaaggcaccaaggaagcaactcgcaacaaaagctgcaagaaaatcagctccggcaaccggaggagtgaagaagccccaccgtttccgtccaggtacggtggcacttcgagagatccgtaagtatcagaagagtactgaacttttgatccgtaagctcccttttcagagactggtaagagaaatagcgcaggattttaagactgatttgaggttccagagcagtgctgtggcggcgcttcaggaagcagcagaggcgtacttggtgggtttgtttgaagataccaacttgtgtgctatccatgctaagagggttaccattatgcctaaggatattcagttggctaggcggattagaggtgaaagggcttagtgtacttttgtttgcaattggatttagtttttaggttgtctttttgttgtaatgtaatgaactatttgataaagaaaatctggaaaagattgctggttgatggtaaagtgttaatttcttcagctaattatttaatcttaccttatttt

SEQ ID NO: 461 - DNA, 688 bp, Artificial Sequence
  Synthetic
ccccccgaatttttctgcggtttcttcttcttcttcctcctcctcgcgctcccccgattcgaagcgtgaagagaggaacggcgcttgcgagaggagagagatggcccgtaccaagcagaccgctcgtaagtccacaggaggaaaggctcccaggaagcagcttgccaccaaggctgctcgtaagtctgctcccaccactggaggagttaagaagccccaccgttaccgccctggaactgttgccctccgtgagattcgcaagtaccagaagagtactgagcttttgatcaggaagctgcccttccagaggcttgttagggaaattgcacaggacttcaagaccgatctgcgtttccagagccatgctgtccttgccctccaggaggctgcggaggcataccttgttggtctcttcgaggacaccaacctgtgcgccattcatgccaagcgtgtgaccatcatgcctaaggacattcagctggctaggaggattcgtggtgagagggcttaaattcccctcggcgattcctttgacaaatgaagcatgcgtcgtagtgttagtagtgggttttaatcttttgcttataagaacaatctgagtagggtgtattttgtggaacaatatgtttctctctgtgacatgatggtgctgtattcgtcttattggtggatctgtcaaaaatactca

SEQ ID NO: 462 - DNA, 729 bp, Artificial Sequence
  Synthetic
aaagcagagagcagagagcagagagaagaaagaagaagaaggagaacaagaaaaaagagaagatggctcgtaccaagcaaactgctcgtaagtctactggaggaaaggcacctaggaagcaacttgctactaaggctgctcgtaagtctgctcctactactggtggagtaaagaaacctcacagataccgccctggtactgttgctcttcgtgaaatccgtaagtaccagaagagtactgagctcctgatcaggaagctcccattccagaggcttgttcgtgaaattgctcaggatttcaagactgatctgcgtttccagagtcatgctgtgttggctctgcaggaggctgctgaggcttacttggttggtctctttgaggacacaaatctttgtgccattcatgccaagcgtgtcactatcatgccaaaggacattcagctcgctaggcgtatcaggggcgagcgtgcttaatttgatcaagtgtggtagctttgttggtgctttagatccttttcttaaaagactgatggtattaaaaaatagtggtaggaacgatgttctatgttgatcttattttgtggtggatggaggtgtgctgtaattgttgttctgtttggggaagtggagaaacatagtacttgttgaatctttctaatgttttattgtcacaccactggtgttgaacaagtttcagaatttgcatctaatgtttagttcaactgtttgg

SEQ ID NO: 463 - DNA, 635 bp, Artificial Sequence
  Synthetic
aaaacttttatattattatcaaacattcgaaatggctcgtaccaaacaaactgctcgcaaatccactggtggaaaggctccaaggaagcagctagctaccaaggccgcgagaaagtcagctccggcgaccggaggtgtgaagaagcctcaccgtttccgtccaggaactgtcgctctcagggaaatcaggaagtaccagaagtctactgagttgttgataaggaagctgccatttcagaggctggtgagggagatagctcaggatttcaagacagatctgaggttccagagcagtgctgttgctgctcttcaagaggcagctgaagcttacctagttggactctttgaagacaccaatctctgtgccattcacgcgaagagggtcaccataatgcctaaggacattcagttggccaggaggattcgtggagaaagggcttaggacgataatttcttatggttatggttatggttaatgtcctgttctctgtattagagttttgtttgcatcttttgttaaatgtcagggttagtgatgtaaataaaatggctggttttgatcaaagtacatgtaacacctctggtttactagtatttgattaatgaaatctgtagttcattttgtttcaaaaaaa

SEQ ID NO: 464 - DNA, 660 bp, Artificial Sequence
  Synthetic
gcttccgtgcctttctcttcctccgcttcaggtaagagattgaggatggcccgtactaagcagactgctcgcaaatctactggaggcaaggctccaaggaagcaattagcaaccaaggctgctaggaaatctgcacctaccactggaggggtgaagaagccacacagatacaagccaggaactgttgcactccgtgagattcgaaagtatcaaaagagcactgagctccttattaggaaactgcccttccaaaggttggtccgtgagattgcccaggatttcaagacggacttgcgtttccagagccacgctgtgcttgcacttcaggaggcagctgaggcttaccttgtgggcttatttgaggacaccaacttgtgtgctattcatgccaagagagtcaccatcatgcctaaggatatccaacttgccaggaggatccgtggggaaagggcttagcaacttttccttaaaaatttggacaactgcaccaatggttttaataacaataagatatctattgacatagatccccccactatctattggtcttttgaacttggattttagttcaaatattgcattgaaaacattgtgtttatgcctactatgtgttgctctcaatatagttttgagaatatggaccctttgaagtaataattt

SEQ ID NO: 465 - DNA, 620 bp, Artificial Sequence
  Synthetic
gttcttctcttcttcccgccctttcgtatttctcagtctggttcaaagatggctcgtactaagcagaccgcccgtaaatccaccggagggaaggcccctaggaagcagcttgccacaaaggctgcaaggaagtctgcccctaccacaggtggagttaagaagcctcaccgatacaggcctggaactgttgctctgcgtgagatccgtaagtaccagaagagtactgagcttttgataaggaagttgccatttcagaggcttgttcgggagattgcacaggatttcaagactgatctaaggtttcagagccatgctgtcttggctctgcaagaggctgctgaggcctaccttgttggcctgtttgaggataccaatctctgtgctatccatgccaagagggttacaattatgcccaaggacatccaacttgcgaggaggatccgaggggagagggcttgatttcttcttttgctcctctttaaactaatatgaccttcattcgaacacttcttttgttttgaatctgaaagctctagcaatagacgctaattgcacccttttaacaatgtattgcttcaaatgcctataatagacctatgttgcccttttgtgttctgtaa

SEQ ID NO: 466 - DNA, 631 bp, Artificial Sequence
  Synthetic
tggtatcaacgcagagtgaccatacaagcttgatttccaccaagcagttgcgctccgcgtctcagctgacaagacagttttctacaactgtaacatggatggataccaagacacactctacacacattcctacagacaattctacaaggactgtactataacaggcaccattgacttcatctttggtgatgcatcggccgtgttccagaactgcaaaatgattgtcagaaaaccaggtgaaaatcaagcttgtatggtcactgctcaaggaagaaaagatcatcgcggagttggtgcaatcgtattacaaaactgcgatatcacagctgagccagcttttactagcgcgcagccaccaattaaagcttatcttggacgtccgtggaaagaatattcaagaactattattatgcagtcttatatcgacgcatttattgatcctgaaggctgggctccatggaatggagattttgctcttaatactttgttttatgcagagtatcagaatagaggagcaggagcaaatattgataaaagagttaaatggggtggttataaaagaaacatttcaccacaagaagctgagaaatatgctcctgctcattttattgaccaagataactggattaag

SEQ ID NO: 467 - DNA, 641 bp, Artificial Sequence
  Synthetic
cggacgcgtgggcacgctgtagtctatcgatgcaatatcatgggataccaagatactctctacgtacactctcagcgccaattctatcgcgagtgtgctatctatggtacggttgatttcatcttcggtaatgcagcagtagtccttcaaaactgcagcatttacgctcgaaagcccatggatttccaaaagaacaccatcactgcccaaaacaggaaggatcctaatcaaaacactggcatttcaatccatgcttgcaaaatcgcagccacatctgacctcgaggcgtccaaaggaagcttccccacttatcttggtcgaccgtggaagttgtactctcgaaccgttgtcatgttatctaacttgggtgatcatatacacccgcgtggttggttagagtggaatgctacattcgcacttgagacattgtattatggcgagtatatgaattatggaccgggagcagcggtagggcaacgggtgacttggccaggatatcgggtgatcacgtcagtggaagaggcaagcaagttcaccgttgcacaattcattttcggatcgtcgtggttgccttcaactggggtggctttcttggcagggttgaatacctgaaattaattgtataatgaacatactccgac

SEQ ID NO: 468 - DNA, 708 bp, Artificial Sequence
  Synthetic
acgcgtcgcatttagcagccaagaaagagttgcgaatttgttttgagttagaagatgaaaggggtaggtagggagacagttcttgggtagttatagtattagtatacctgggaaatgctaagtcatggggacgaactttgctgggtaatgaagaaaataatgaggctgagagggagagagattttacagagtgggttgaaagggtggcttctcgaatccgagaacagagcttgaatacaagccaagtaatggagagtgtgagtgagagcaaggtgggtgctcttgttattacagttgacaaagctgcaggccagtacaagtccgtgcaggatgctgtcgatgccgtgccctctaataacaatcagcgagtcatcatacgaatagctgctggaatctaccaggaaaaggtcgatgttcctaagaagaaagcatttataacatttgaaggggcaggagctggttctaccataatcacatggcatgacacagctagcagtgctggaagcacgcatgacagtgccagtgtggccatcaactctgactatttcatagctagaggaatcaccttcaagaactccgcaccacctcctccaggtggagccgtaaataagcaagctgttgcattaagaatctcaggcgacaaggcttcctttttcaattgcaaattcttaggcgcccaagatactctatacgaccacaagggtaggc

SEQ ID NO: 469 - DNA, 693 bp, Artificial Sequence
  Synthetic
gaggatttcaaggcatgggtagagagaatggggagagagttcgaactcaaagcaatgggaatagcctgaaaaaggaagaatcccaagccctccccataatgcaaaacggttcaaatccgttaccagagagtgtgattcgtgtgagtaaagcggggagtgggcacacctctgtgcagtcagccattaattctgttccctcgggtaactctaagagagttgtgatccatattgatgctggagtttatgaggagaaagtgagaatccctgggaataaggactttatcactttggaaggagatggggctggatctaccattattaccgggagtgaaacagcagcaacagcaggaagcttagcaaatagtgcaattgtaggcgttgacgctgattactttattgcaaagggtataacatttaagaataccgcaccttcaccggagggaactaacaacaggcaaggagtggcattaaggatatcaggtgataaggcagcattctatagttgcagtttcattggtacacaagacactctttatgatgacaacggaagacattactttgagaattgctacattgagggagcctcggatttcatttgtggagatggccagtcattatataagggatgcacattgcatggaaccaaatcaggtgcattcactgcacaaagacgcagtagtgctggtggagaca

SEQ ID NO: 470 - DNA, 657 bp, Artificial Sequence
  Synthetic
gggacgttcaagctgacattgcagtttacggaggactaccccaacaaacctcccactgtgagatttgtttcaaagatgttccatcccaatatttatgctgacggaagtatttgcctcgacatcctgcaaaatcaatggagtccaatctacgatgtcgcggccattcttacttccatacagtcattgctttgtgatcctaacccgaactcgccggccaactccgaggcagctcggatgtacagcgaaaaccgccgagagtacaacaggagagttcgcgacatagtcgagcagagttggacggcggagtagctccccttggttcaagagcttgtaagagtggccatcacagagagatgtgtgctgctccgagcacacataaagaatcttgtcaaaaaacaatccggaaagctgtcgcctctacagaccagcgttgaaggtcgaccatcgaactcgtttgcttctgttggaaccagggccagtgttctggtactcaccatagaacagggtgctgagagcgaagtccccgttccattccaaccatccacggggttgaattatgtcactgatgaacgacttcatgaacaccgtccgcgagtagagcttccacggccttccgagtttatgaaagacagccccgtgttctgtcgcttatcgacg

SEQ ID NO: 471 - DNA, 570 bp, Artificial Sequence
  Synthetic
atcgacagtagttcgagtagcgcaggatggatcggggcagtattcgtgcgtccaggacgcgatcgatgcggtgccgctgtgtaacaggcagcgcattgtcatccaggtagcgcccgggttctatcgccagccggtctatgtccccaagtccaagaatctgatcactctgctcggcagctgcgccgaatcgaccattctaagctgggggaattgcgccacttccatcgatcatcacaaggcatcacaagtgattgggactggaacatttggttgcgggaccgtgatcgtggaaggcgaggatttcattgcacaaggcattacgtttgagaactcttcacccaagggctctggccaggccgtggcgatacgcgtcacagctgacagatgtgctttctacagttgccgcttccttggctggcaggacacggcctatctccactatggacgccagtactttcgggactgctacattgaaggaagcgtcgactttatctttggaaacgcgacggtgctgctggaacactgccacatccactgcaagtccagcggctatatcaccgcacagcagcg

SEQ ID NO: 472 - DNA, 660 bp, Artificial Sequence
  Synthetic
aatactaatgcacagctgctgatgctcaatcatggttaagtacagccttaaccaacctcgaaacgtgcagagctggtttcgaagaacttggggtcacagattatgtgatgccgttgatgtcaaataatgtttcatctttaattagtaacactttgtctttgaaccatggttactatactgagccaactgcaactcaagtagatggttttccaacttgggttgcacctggtgatcggaaactattgcaatcatcttctccagcttctcaggcgaatattgtggtggccaaagatggttcagggaatttcaagactgtgaaagaagctgttgctgctgcgggaaagaggaagggaagtggaagatttgtgatatatgtgaaggcaggaatttacagtgaaaatgtggagttaggatcaaagttgaagaatataatgttagttggagatggaattgggaagacaattatcacagggagcaagagtgttggaggaggatccaccaccttcaaatcagccactgttgccgttgtcggtgatggatttatttgtcgaggcataacaattaggaacactgctggcccccagaaccaccaagcagtagctctacgatctggctcagacctttcagtattctatcaatgtagttttgagggataccaag

SEQ ID NO: 473 - DNA, 370 bp, Artificial Sequence
  Synthetic
cccacgcgtccgacaggcaacttcacaaagataatggacgccataaagaaagctcctgattatagctcgacacgtttcgtcatatacattaaaaaaggtttatatttggagaatgttgagatcaagaagaagaaatggaacattgtaatgttaggtgatggcattgacgtgactgttatttccggtaaccgcagcttcatcgatggttggaccactttccgatcagctacattcgcggtaagcggaagaggattcttagcaagagatataacgttccagaacacagcagggccagagaagcatcaggcggtagcactgagatcagactctgacctctctgtgttctacagatgtgcgatgaggggttatc

SEQ ID NO: 474 - DNA, 624 bp, Artificial Sequence
  Synthetic
ggggattcattgcacgggacatgacattcgagaacacggcaggaccccaaaagcagcaagccgttgcatttcgctccgactcagacttgtctgtgttgttcagatgcgcgttgagaggctaccaggacactctctacgcccattctatgcgccaattctaccgaaactgtataattactggcacggtagacttcatatttggagacggcacggttgtcttccaaaattgtcagatattagcccgaaagggactacccgaacaaaagaacaccatcacagctcaaggccgaaaagaagctgctgaaacaacaggcttctccatccaattctctaatatatctggcgaaccagatctattagcttcacttaactctacacaaacattcctaggtagaccgtggaaggcctattcacgcactgtcatcatgcaatcatacatgagtaatgtaattaaaccacaaggctggttagagtggaacggtaatatatcacttgacacattgtactacgccgagtatcaaaattacgggcccggtgcgggcttaggcgctagagtcaattggcctggttatcatctactcaatgattcatcgcaggcaaataatttcacagtggctcaattca

SEQ ID NO: 475 - DNA, 657 bp, Artificial Sequence
  Synthetic
cccacgcgtccgggaagttattggagagtccagcagaggacattaaagctaatgcagtggtagcacaagatggatcaggggattatcaaacacttactgaagcagttgctgcagcaccagataagagcaagacacggtatgtgatctatgtcaagaagggaatttacaaagagaatgtggaggtgactaagaagaaaatgaacttgatgattgttggcgatggcatgaattctaccattatcactggtagccttaatgttgtggatggatcaaccaccttccgctctgccactcttgctgcagttggccaaggatttatactacaagacatctgtatacaaaatacagcaggaccagagaaacaccaagcagtggcacttcgagtgggagctgatttgtctgtcataaatcggtgtcgtattgatgcttatcaagataccctttacgcacattctctaaggcaattctatagagacagctacgtaacaggtaccgtcgacttcatatttggtaatgcagccgttgtactccagaaatgccaactagtacctagaaaacctggtaaaaaccagaacaacatggtgactgcacaaggccgtacagatccaaatcaggccactggaacttccattcaattatgtgacataatagctagtc

SEQ ID NO: 476 - DNA, 356 bp, Artificial Sequence
  Synthetic
cccacgcgtccgcttcttcagggttcaggtgtgaaagctgacgccaccgtggcagctgacggtagcggtacatttaaaactgtggctgctgcggttgccgcggcccctgaaaatagtaataagaggtatgtgatacatataaaagccggagtttacagagagaatgtggaggttgctaagaagaaaaagaatataatgtttatgggagatggtcggacgagaactattatcaccggaagtcgaaacgttgtatacgggatcaccactttacactccgccaccgttgctgctgtcggcaacagattcttatctcgggacatcactttccaaaacacggtgggtccgtctaagcacca

SEQ ID NO: 477 - DNA, 444 bp, Artificial Sequence
  Synthetic
cccacgcgtccgacgtttgagaattacgccggaccggctaagcatcaggccgtggcactccgtgttggtggagaccacgcggtggtttaccgttgcaacattatcggttaccaagacgcgctttacgtacattctaaccgacagtttttccgcgaatgcgaaatttatggaacggtcgattttatattcgggaatgcggctgtgatcttacagagttgtaacatttatgcgcgtaaaccaatggctcagcagaagattactattacggctcagaaccgaaaagatccgaatcagaatacggggatttcgattcatgcttgtaagctactagcaacaccggatcttgaagcctctaagggtagttatccgacgtatctcggccgtccgtggaagttgtattctagagttgtgtacatgatgtcggatatgggtgaccatattgac

SEQ ID NO: 478 - DNA, 539 bp, Artificial Sequence
  Synthetic
ccgtattccaaaactgcaaattaatagtaaggaagccaggggaacaccagagctgcatggtaactgctcaaggaaggaccacacctgaatcgaaaggtgcattcgttatacaaaattgtgagatcaaagcagaaccagagttactagcagcaaatccaccagtgccggcgtttcttggacgtccatggaaggaatattcacgaacaattatcatgcaatcgtttatcgacggattcattgatccagtaggatgggctccatggaatacaactgactttggactacatacttgttggtacgctgagtatcagaatagaggtccaggagctagccttgacaaaagggttagtcattggagaggttaccagagggtaatttcaggagatgttgcaaattcatttactgctggtgtttttattaatcccacagatacttccttccttcctaaggctgatattccctatgaggctggcatgatgaacgtgtaaacttttttgatgtaaccttcaaaaatattacaactacttcattatgttttt

SEQ ID NO: 479 - DNA, 697 bp, Artificial Sequence
  Synthetic
  misc_feature (153)..(153): N at this position can be a, c, t, or g.
tgaaaacttcttgaagcaaattaccacattggtcatgacaattatcctacgtggtttcctgtttctgatcgtaagcttttggctaacaccccgactcctcatgcaatagttgcaaaagatggaagtggaaaatttaaaacagtttctgatgcntcttaaagcataccctcaaaaccatcaaggcaaatacatagtatatgtcaaggctggtgtttacaacgaacaagtccttgtcgataagacacaaccgaacgtgtttatctttggagatggcgcggggaaaacaatcataacttcagacaataatgttggaatcatgaaattcactaccatgaattctgcaacattcggtgttaatgcaccagggtttgttgccaaaggaattacattccgaaacacagctggtccaaaaggacaacaagccgtggcactcagaatacaaggtgatcaatctgcagttttcgactgcaacattgaaggctaccaagacaccttatactatcaaacccaacgtcaattctatcgcaattgtgtcatatcaggcacgattgatttcatctttggtagaggcacggctgtaatccaagattcaaccatgattttgagaaaaccaggagacgaccaaatatggaacacaatcacagccgacggtagagaggtgcagtcacaaccaacaggagttgcattacaaaattgc

SEQ ID NO: 480 - DNA, 702 bp, Artificial Sequence
  Synthetic
ggaaaatgtcagtcggagctatgtggtttattgcagttatagccattttgccactccttttatgtggtgaaggccagcaagtgaaaacacctcacgcaattgttgctaaagatggctccgggaattacaccacaataactgatgccataatttcagcaccaaacaatagtgtaaataaatactacatcaaaattaagcaagggacatattatgaatatattcaactagataaatggaaaacaaacatagtcctaatcggtgaaggcatggacaatacgataatttcaggaaataagagttacggtggtgatgacatcaaaaccagcctcaccgctactgtgggcgtcaatgggaagggctttatggcccaagatatcacatttaggaataatgctggacgagagaaccaacaagcagtagcattaagagcagaagctgactttctcactttttataggtgtcgtttcgatggctttcaagacaccttatacacaaaaaagggagtacaattttacagggattgtgaaatacttggaaccatagatttcatctgtggtgatgcaacatccgtattccagaactgcttaattgaagcacgtctgccactgcccaagcaatataatacaattacagcacaacaaagaaaatttttgaacgacacaacaggaatagtgctgcaaaattgcacactaaaagcaactc

SEQ ID NO: 481 - DNA, 293 bp, Artificial Sequence
  Synthetic
aagaccataattactggtaataagtccgtcaagggacctggcattggttcaacttggcatacttgcactgttggtgtgagtggagaaggtttcgtggctagggatataggattcgagaacacagcaggaccagcactagaacaagcagttgcactacgagtgaatgctgacaaggcagttatctacaactgcaaaatcgatgcttatcaagacacactatacgcacactctggtagacagttttatcgcgattgtatcatttcaggaaccatagatttactgtttggtgatgc

SEQ ID NO: 482 - DNA, 571 bp, Artificial Sequence
  Synthetic
  misc_feature (105)..(105): N at this position can be a, c, t, or g.
gcacacctctgttcaggctgccattaactctgtgtcctctggtaactctaaaagagttgtcatccatattgctgccggagtttatgatgagaaagtgagaatccnctgggaataagcactttatcactttggaacggagatggggctggatccaccattattactgggcattcaacagaagcgactgcaggaagcctagcaaatagcgcaaccgtggccgttgactctgattatttcattgcaaggggtataacatttaagaattcagcgccttcaccaaagggatataacaacaggcaaggagtggcattaaagatatctggtgataaagcatcattctataattgcaatttcattggtacacaagatactctttatgatgacaaaggaaggcattactttgagaactgctacattgagggagcatcggacttcatttgcggagacggccaatcattatataaggggtgcacactacatggaacctcatctggcgcgttcactgcacaaagacgtagtagtggtggtggagaaactggctactcatttgtaggttgtaaactaactggtt

SEQ ID NO: 483 - DNA, 839 bp, Artificial Sequence
  Synthetic
cttttggctaacaccccaactcctcatgcaatagttgcaaaagatgaaagtggaaaatttaaaactgtttttgatgctcttaaagcataccctcaaaaacatcaaggaaaatacataatatatgtcaaggcgggtgtttataacgaacaagtccttgtcgataagaaacaaccaaacgtgtttatctatggagatggcgcggggaaaacaatcataacttcagacaaaaatgtcgcaatcttgaaattcagcaccatgaattctgctacatttggtgttaatgcaccaggatttgttgccaaaggaattacattccgaaacacagctggtccaaaaggacaacaagccgtggcactcagaatacaaggtgaccaatctgcagttttcgactgcaacattgaaggctatcaagacaccttatactatcaaagcaaacgtcaattctatcgcaattgtgtcatatcaggcacgatcgattttatttttggcaggggcacagctgtaatccaagattccaccatcattttgagaaaaccaggggatgaccaaaaatggaacacaatcacagcagatggtagagaagtgcagtcacaattaacaggagtagcgttacaaaattgcaaaatcgtcgcagaaaaggaactcatcgatactaaaatcgtccagaatttcttgggacgtccatggaaggcgttatcgaccaatgttgtaatggagagtgaaattggtggttttattaatccagaaggatggaagatatgggataacgaacattacgagcaaacatgtgaatgttatgaatatgctaatagaggacctgggcgctgctactaatggac

SEQ ID NO: 484 - DNA, 419 bp, Artificial Sequence
  Synthetic
cccacgcgtccgaacatcttcatgttcggagatggtgcaagaaagaccgtcatttcttacaacagaagtgttaaactcagccctggaaccaccacttcccttagtggcacagtccaggttgagtccgaaggattcatggcaaaatggatcggattcaagaacaccgccggtccaatgggacaccaagctgtggctatcagagtgaacggagaccgtgccgtgatcttcaactgcaggttcgacggttaccaagacaccttgtacgtcaacaatggtcgtcagttctacagaaacattgtcgtgtcaggaacagtcgacttcatcttcggcaaatccgcaaccgtgatccaaaactcactcattgttgtccgtaaaggaaacaagggacaattcaacacggtcacagccgatggaaacga

SEQ ID NO: 485 - DNA, 743 bp, Artificial Sequence
  Synthetic
tttacatctcgattctaatactacgatgatctagagaaagtacacaccccatacaaaacaaagaggacatcacgatttgcttcatacactattaatcaataatttttgtagccaacactacgtaggaacacattacacaacaatctctcaaagaccgagcgaaaaggggaaaccggacgacgataaccagcctccaccaccaataaactgaccagccgtatatttttgagcttcagcagcagccgtaattaccttaaagcccctccacttcactctatttgcagctccagcccctgctcctgtgttcgaatactctctgtaagtcagagtgttcaacgcaaaagtcccggtccactcggaccacccttcgggtcggatcacgtcggagatagccgactgcattatcaccgtttgtgaatattccttccatggccgacccaagtacgtcggaaaactacctttcaccgactgtaaatccgacgtggcaccgatcctacatttctggataacgatccctgtgttctggttaggatccgttcttccctgagctgtgaccatgtttttctgaccggaattagggcggcgagcgtggatgtcacagtcttggagcacgacggcggcgtttccgaagatgaagtcaacggttccggcgatgagacatttgacgaagaattgacggttagagtggacgtatagagtgtcttgataagctaacatgtcgcaattgtagaaggcggagaaat

SEQ ID NO: 486 - DNA, 685 bp, Artificial Sequence
  Synthetic
  misc_feature (31)..(31): N at this position can be a, c, t, or g.
  misc_feature (536)..(536): N at this position can be a, c, t, or g.
  misc_feature (541)..(541): N at this position can be a, c, t, or g.
gctgcagatatcaaaaaggatcttcacctangatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacanaatanggggttccgcgcacatttccccgaaaagtgccacctgatgcggtgtgaaataccgcacagatgcgtaaggagaaaataccgcatcaggcgaaattgtaaagatatcgcggccgcttaattaatgacaagaacacgaactgagat

SEQ ID NO: 487 - DNA, 1018 bp, Artificial Sequence
  Synthetic
catcaccgtctgcgccattgacaatgccgccatgaacgaactcctcgaaaaacacctccctacttacacactcaaaaacgtcctttcccttcacgtattcgccgattacttcggcgccaagaaacttcaccaacttacaaaaggcagttcttctttccgccaccatgttccaagccactggtgaagctccgggaacctccggttacatcaacatcaccaacatgaaaggcggcaaagtaggtttcgcaaatgaagataacgacggccatttcaccgctacgttcgttaaaaccgtactagaaatgccttacaacatttcagttattcaaattagccatgttttaacttcagccgccgccgaagctcctgttgcagcgcccagtgacttaaacatcacaaccctaatgtccgaacaaggatgcaaagccttttccgatttactaaaatcccatccagatgtttcaaaaacatttgcagaaaatgtagaaagtggattaacagtgttttgtcctacagatggagttttaaacggtttcatgccgaaattcaagaagttgactaaagatggtcaagcttctttattattataccacggtattcccgtttacaattctttaggtatgttgaaatccaaccaatgggttaatgaacactttagctactgagggaaaaaataagtacgacttcactgtacaaaatgatggagatgacgttatgttaaagaccaaggttgtttacagcgacaatatctggaacattgtaccgatgaggaaccattgtcggtttataaagttgataaagttttgttgccacgggaactgtttaaagcagtagcagaagaaccagcacctgcgccaaagggttcgaagaagaagaagagtaaaaaaggtggcggtgacgatgtagaggacgacagtgcgccggagcctagtctggaggaagacgatgctccggcggatgagtcggaaaacttgaacggagctattagtgtgaaaagtagtgggtggttggttacagt

SEQ ID NO: 488 - DNA, 385 bp, Artificial Sequence
  Synthetic
cccacgcgtccggaagaagttccgtataacatctccattattcagatcagtagagttttaccgtcggagactgcggcggctccgactcctgctccggcggagatgaatcttaccggaataatgtcggctcatggatgcaaagtgtttgctgagactcttctcactaaccctggagcttcaaaaacctatcaggagagtttagaaggaggcatgacagtgttctgtccaggagatgatgcaatgaaaggtttcttgcccaaatacaagaacttgacagctccaaagaaagaagcatttctcgatttcctcgctgtcccgacatattactcaatggcgatgccaaatccaacaatggtccgatgaacacacttgcgacagatggagc

SEQ ID NO: 489 - DNA, 935 bp, Artificial Sequence
  Synthetic
aaaatcatttttgcccagggatgatcgcttcatggttatcaaggaagacatggaaagaactttgaagaacactaacatgaaaccattgaatcattcatcatacctgcgattgcaagtcttgtgtcagagcttctggaacgtggaagagaagttgctcttgttaaatgacttgactctcgctgagctgaaagctttcattccagagcttctttcccagctgtatattgagggcctttgtcatggaaatttgctggaggaagaagcactaaacatatcaaacatttttagaagtaatttctctgcacaaccgctaccatctgagatgacgcataaagagtatgtcatgtgtcttccagccaccgctgacctagtcagagatatcagagtaaaaaataaactggaaacaaactctgtggttgagctgtattttcagattgaacctgaagaagacacttccttgataaaattaaaagcagtaacagatctctttgatgaactcgtggaggagccactttttaatcagctaaggacaaaggagcagcttggttatgttgttgactgtagtgcacgtgtaacatatcgcataatggggttctgtttccgtgttcagtcatctgactatgatcctgtctacttagaagggaggattgacaacttcatagatagtgtgaaagagttgttggacggcctcgatgataaatcttttgagagctacagaagtgggttgatagcaaaacttttggagaaagacccatcgctcgcatatgaaacaaatcgcctttggggtcagattactgataaaaggtacatgtttgacatgtctgagaaggaagcggaggagctgcggagcattcaaaaaagtgatttagttgagtggtaccatacttatttaagacgaccatctcccaagtgccggagactctctgttcgggtat

SEQ ID NO: 490 - DNA, 600 bp, Artificial Sequence
  Synthetic
gaatcacgaagctagagacgtccgcgatgttttacccgatatcgggtatgagtcccgacaacgacaactcggctcttcacgtctcatcttcaggttggacaagacgaaacagtcatgaacgttcttgtggaactatttgttctcagtgccaaacaaccagcttttcatcaacttagaactattgagcagctcggatatgtaactgctttgataaacagaaatgattctggagttcaaagcgttcagttcattatacagtccactttgaaggatcccaaagctattgaagaaagagtggaagattttctcaaatcatttgaggcaacgcttgtgaacatgagcgacgaggaattccagagaaacttggaagctcttgttgaaatcaagcttgagaaacacaaaaatatttacgaggagaccaacttcttctggaaggaaatcgacaatggggtgtgcaagttcgacaggagagaagtggaggttgctgcgcttcgaaagctcaagaaagaacagctgctacagttttacatggattacttgaaaagtggtgcaccaatgcgaagaaagctgagcatccagatctatggcaagctccacaag

SEQ ID NO: 491 - DNA, 682 bp, Artificial Sequence
  Synthetic
  misc_feature (115)..(115): N at this position can be a, c, t, or g.
acgcgtcgcatttttcgttctttttgcgtttctctctctctctcgctctctctttctgtttcctgtgaaaatgcagatctttgtgaagaccctgacggggaagaccatcaccctnggaggtggaaagctccgacaccattgataacgtcaaggccaagatccaagacaaggagggcatcccccctgaccagcagcgcctcatctttgccgggaaacagcttgaagatggccgtacccttgcagactacaacatccagaaggagtccaccctccaccttgtcctccgcctccgaggtggtatgcaaatcttcgtcaaaaccctcaccggtaagaccatcaccctcgaagttgagagctctgacactatcgacaatgtcaaggccaagatccaagacaaggaagggattccccctgatcagcagaggcttatcttcgctgggaagcagctcgaagacgggcgaaccctcgctgactacaacatccaaaaggagtccaccctccacctcgtgctgaggctccggggaggcatgcagatctttgtcaaaaccctgacggggaagacaataacactggaggtggaaagctctgacacaattgacaacgttaaagctaagattcaagacaaggaagggatcccccccgatcagcagcgtttgatctttgccggcaagcagctggaaga

SEQ ID NO: 492 - DNA, 642 bp, Artificial Sequence
  Synthetic
attcttctctccctttgcgaaacaagctaactttctcccgagtctttttcttcttcctctcaagatgcagatctttgtaaagacactcactgggaaaaccattactcttgaggttgagagttcagacacaattgataacgtgaaggccaaaattcaagacaaggaagggattcccccagaccagcagaggctgatatttgctggaaagcagcttgaagatggccgaactcttgctgattacaatattcaaaaggagtctaccctccaccttgtcctccgtctacgtggtggtatgcagatttttgttaaaactcttactggcaaaaccattactcttgaggtcgagagttcagacaccattgacaatgttaaggccaagattcaagataaggaaggcattccacctgatcagcaaaggctgatctttgctggaaagcaacttgaggatggaaggtccctcgcggattacaacattcaaaaggagtcgaccctacatcttgtcctccgtctacgtggtggcatgcagatttttgttaaaactttaacgggcaagacgatcactcttgaagttgagagctcagataccattgacaatgtaaaggcaaagatccaggacaaggagggtattcctccagaccagca

SEQ ID NO: 493 - DNA, 1533 bp, Artificial Sequence
  Synthetic
  misc_feature (84)..(84): N at this position can be a, c, t, or g.
  misc_feature (341)..(341): N at this position can be a, c, t, or g.
  misc_feature (489)..(489): N at this position can be a, c, t, or g.
  misc_feature (506)..(506): N at this position can be a, c, t, or g.
  misc_feature (509)..(509): N at this position can be a, c, t, or g.
  misc_feature (667)..(667): N at this position can be a, c, t, or g.
  misc_feature (680)..(680): N at this position can be a, c, t, or g.
  misc_feature (790)..(790): N at this position can be a, c, t, or g.
  misc_feature (796)..(797): N at this position can be a, c, t, or g.
tcatcgccttcaaatttctctctcaaggtttgagaaaatttcctcaatttctcgctttaggagttcttttttattgaatcaccngatttgggtgtgtcaagccctaattttgaagttcattttttcaattgtttgttgttgattttatgttataacagatgcagatcttcgtaaaaaccctaaccggtaagaccatcactctcgaggttgagagttccgacacaatcgacaacgtaaaagccaaaatccaggataaggaaggaattcccccagatcagcaaaggcttatcttcgccggcaagcagcttgaggacggccgtaccctagccgattacaacatnccagaaggaatctaccctgcacttggtcctccgtctgcgtggtgggatgcagattttcgtcaaaaccctcactggcaaaacaatcacccttgaggtggaaagttctgacaccatcgacaatgtcaaggctaaaattcaggataaggangggaattccaccagacncangcagaggttgatcttcgctggcaagcagcttgaggatggtcgtacccttgccgattacaacatccagaaggagtctacccttcaccttgtcctccgtctccgtggtggtatgcagatctttgtcaaaacgctcaccggcaaaaccatcacccttgagngtcgagagttccngacaccatcgacaatgtcaaggccaaaattcaggacaaggagggcattcccccagaccagcagaggttgattttcgctggcaagcagctcgaggatggccgtacactagnctgatnntataacatccagaaggaatccacccttcaccttgtcctccgtctccgtggtggtatgcagatcttcgtcaaaacactcaccggcaagaccatcaccctggaggttgaaagctctgacaccattgacaatgttaaggccaagatccaggacaaagaggggattcccccagatcagcagaggttgatcttcgcaggaaagcagttggaagatggtcgcacccttgcggactacaacattcagaaggagtctactctgcacttggtgctaaggctgaggggaggaatgcagatcttcgtgaagacattgaccgggaagaccatcaccttggaggtggaaagctctgacaccatcgacaatgtcaaagctaagatccaggacaaggagggtatcccaccggaccagcagaggttgatctttgctggtaagcagcttgaggatggaaggaccctggccgactacaatatccagaaagagtcaacccttcaccttgtcctccgtctccgtggtggtttctaggttgcctgttgttgatgttgttgtgtcgtgttgattggctgtgtcttgttgtggtcatgatgtgttttgtctactaaggtcccaaagatgttcaattctgtttctgttcgccgtttctttcatattttctgttgtgaataaagacaccagattctgtcctagtgcttaggttttgtgctctctgttggcagtaaatgaactttcctttgttttatccatt

SEQ ID NO: 494 - DNA, 293 bp, Artificial Sequence
  Synthetic
ggcagagagaggagagggagagagagatgcagatcttcgtgaaaaccctaacagggaagaccatcactctcgaagtcgagagcagtgataccatcgacaatgtcaaagccaagatccaggacaaagaagggataccaccagatcaggagaggctgatatttggtggcaagcagcttgaagatgggcgcacactggctgattacaacatccaaaaggagtccacactggatctggtgctgaagttgcgtggagggaccatgatcaaggttaagaccctcaatgggaaggaaatt

SEQ ID NO: 495 - DNA, 1354 bp, Artificial Sequence
  Synthetic
acttttctctttacttcaaacgcctctcaagagcagatcttcgtcaaaacccttaccggaaagacgataacccttgaggttgaaagctccgacacaattgacaacgttaaggctaagattcaggacaaagaaggaatcccaccggaccagcaaaggttgatcttcgccggaaagcagctcgaagacggcagaaccctagctgattacaacatccaaaaggaatccacccttcacttggtgctccgtcttcgtggcggtatgcaaatctttgttaaaaccctaaccgggaaaacaataacccttgaagtcgaaagctctgacacaattgacaatgtcaaggcgaagattcaggacaaggagggaatccctccagaccagcaaaggttgatttttgccggaaagcaactcgaagacggcagaaccctagctgattacaacatccagaaggaatcgacccttcacttggtccttcgtcttcgtggtgggatgcagatcttcgtcaaaaccttaactgggaaaacaatcacccttgaagtcgaaagctccgacaccattgacaatgtcaagggtaaaatccaggataaggagggaatcccaccagaccagcaaaggttgatttttgctggtaagcaattggaagatggccgtaccctagctgattacaacattcaaaaggagtcgactttgcaccttgtgctccgtcttcgtggtgggatgcagattttcgtgaagacattgaccgggaaaaccatcactcttgaggtggaaagctctgacactattgacaacgttaaggccaaaatccaggataaggagggaatcccaccagaccagcagagattgatttttgctggtaagcagctggaggatggccgaaccctcgctgattacaacattcagaaggagtctacccttcacttggttctccgtctccgcggtgggatgcagatcttcgtcaaaacactcactgggaagacaatcaccctcgaagttgaaagctccgatactatcgacaatgttaaggctaagattcaggacaaggaaggtattccaccggaccagcagagattgatttttgctggtaagcagttggaagatgggagaactttagctgattataatatccagaaggaatccacactgcatttggtgctccgtcttcgtggtgggatgcagatttttgtgaagacgttgaccgggaaaaccatcactttggaggtagagagttctgatacgatcgacaatgtgaaggctaagatttaggacaaggagggtatcccgccagatcagcagaggctgatttttgctgggaagcagttggaagatggaaggactctggctgattataatattc

SEQ ID NO: 496 - DNA, 862 bp, Artificial Sequence
  Synthetic
cccacgcgtccgctcaaaatcttaaaaactttctctcaattctctctaccgtgatcaagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctccgtggtggtatgcagattttcgttaaaaccctaacgggaaagacgattactcttgaggtggagagttctgacaccatcgacaacgtcaaggccaagatccaagacaaggagggcatcccccccgaccagcagcgcctcatcttcgctggtaagcagctcgaagatggccgcaccctcgctgattacaacatccagaaggagtctaccctccaccttgtccttcgcctcaggggtggtatgcaaatcttcgtcaaaaccctcactggaaagaccattactctcgaggtcgagagctccgacaccatcgataatgtcaaagccaagatccaagataaggagggaatctctcccgaccagcagcgcctcatctttgctggcaagcagctcgaagacggccgcacccttgctgactacaacatccagaaggagtcgacccttcaccttgtgctgcggctccgagggggcatgcagatattcgtcaaaaccctgaccgggaagacgataaccttggaagtggagagctctgacacaatcgacaacgtgaaagcgaagatccaagacaaggaagggatccctcctgatca

SEQ ID NO: 497 - DNA, 731 bp, Artificial Sequence
  Synthetic
ccccgagccaagaggggaaaaaaaaagggaagaaatttttttcttttttttttgttcgcctccgcttcttcctcacgcagctctcgcctcgcctcgccgcccgccactagagaggagagggagaaggagaaggaggcgaatcccagcaaaagaagatgcagatcttcgtgaagaccctgactgggaagaccatcaccctcgaggtggagagcagcgacaccatcgacaatgtcaaggctaagatccaggacaaggagggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaaatgctatgcgcgcctgcaccctagggctgtcaactgccgcaagaagaagtgtggtcacagcaaccagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcgaaattgtc

SEQ ID NO: 498 - DNA, 1631 bp, Artificial Sequence
  Synthetic
  misc_feature (663)..(663): N at this position can be a, c, t, or g.
cgaaaaatttctccccaatctcgcgaggctctcgtcgtcgaatcgaatcctctcgcgtcctcaagatgcagatctttgtgaagacattgaccggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaaggccaagatccaggacaaggagggcattcccccggaccagcagcgtctcatctttgccggcnaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggcaagaccatcaccctggaggttgagagctcggacaccatcgacaacgtcaaggccaagatccaggacaaggagggcatccccccagaccagcagcgtctcatcttcgccggcaagcagctcgaggatggccgcaccctcgccgactacaacatccagaaggagtctaccctccacctggtgcttcgtctccgtggtggtatgcagatcttcgtgaagaccttgactgggaagaccatcactttggaggttgagagctccgacaccattgataatgtgaaggccaagatccaggacaaggaggggattcccccagaccagcagcgtctgatcttcgctggcaagcagctggaggatggacgcaccctcgccgactacaacatccagaaggagtccaccctccacctggtgctccgcctccgtggtggtcagtaatcagccagtttggtggagctgccgatgtgcctggtcgtcccgagcctctgttcgtcaagtatttgtggtgctgatgtctacttgtgtctggtttaatggaccatcgagtccgtatgatatgttagttttatgaaacagtttcctgtgggacagcagtatgctttatgaataagttggatttgaacctaaat

SEQ ID NO: 499 - DNA, 1443 bp, Artificial Sequence
  Synthetic
  misc_feature (1263)..(1263): N at this position can be a, c, t, or g.
attattactcgaccacgcgtcgaaaaatctcccctcgaagcgaagcgtcgaatcgccttctcaagatgcagatctttgtgaagaccctcaccggcaagaccatcaccctcgaggttgagtcctcggacaccattgacaatgtcaaggccaagatccaggacaaggagggcatccccccggaccagcagcgtctcatcttcgctggcaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagaccagcagcgtctcatcttcgccggcaagcagctggaggatggccgcacccttgctgactacaacatccagaaggagtccaccctccaccttgtgctcaggctcaggggaggtatgcagatcttcgtcaagaccctgaccggcaagaccatcaccctcgaggtcgagtcctcggacacgatcgacaacgtgaaggccaagatccaggacaaggagggcatccccccggaccagcagcgtctcatctttgctggcaagcagctggaggatggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaatgtgaaggccaagatccaggacaaggagggtatccccccggaccagcagcgtctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcacccttgcggattacaacatccagaaggagtccacactccacctggtgctccgcctccgtggtggccagtaagtcctcagccatggagctgctgctgttctagggttcacaagtctgcctattngtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtcc

SEQ ID NO: 500 - DNA, 557 bp, Artificial Sequence
  Synthetic
cccagaccagcaaaggctgattttcgcagggaagcaactggaagatggacgtacattagctgattacaacattcagaaagagtcaacgctccatttggtcctgaggctcaggggtggaaccatgatcaaggtgaagacactcactgggaaggaaatcgagatcgacatcgagcccactgataccattgatagaatcaaggagcgtgttgaggagaaagagggtattccacctgttcagcagaggctcatttatgctgggaagcaacttgctgatgataaaactgccaaggattacaacattgaaggtggctcagtgctccatctcgtgcttgctctgaggggtggtcagtagatgtagtttccatgcccgcattatctctaaagggagaagcatatttgctattccatttctatctgtagttgctgcagacttatagctatatttggtaggattattgaagtactatgcgattggcgcattgtgtattggaatcaattgtcatctgtactggaaaggaaatattggaactaagttaagcagtagtttatcaattgcc

SEQ ID NO: 501 - DNA, 699 bp, Artificial Sequence
  Synthetic
cccccccccgagtatcattccattctcaagagggaagaaattctagcgccgtagtgctcctcgagttctctcctccaaagcgaagatgcagatcttcgtgaaaaccctaacgggtaaaacaatcacccttgaggttgaatcttccgacacaatcgataatgtgaaagccaagatccaagataaggaagggattcccccagatcagcagcgtctgattttcgccggaaagcagcttgaagacggccgaaccctagccgattacaacatccagaaggagtcgactcttcatctcgtgctccgcctccgtggtggtgctaagaagaggaagaagaagacttacaccaagcctaagaagattaagcacaagaagaagaaggttaagctcgctgtacttcagttctataaggtggatgattctggaaaagtccagaggcttcgtaaggagtgtcctaatgccgagtgtggtgctggaacttttatggctaaccactttgaccgtcactactgtggtaagtgtgggctcacctatgtttacaacaaggccggcgccgattgaggcttatgcttagctctgttttaatgctgtcgtcaattttatccttttgtcgaacggtaatttagtatggattttcctttttaaatggtgtggtaactatgggaattttgagttatttttaaaggttttgcttattattcttg

SEQ ID NO: 502 - DNA, 588 bp, Artificial Sequence
  Synthetic
gtagaagatcgctggtgaggggcggagaaaatgcagatcttcgtgaaaactctgaccggtaaaactataacccttgaggttgaatccagtgacacaattgacaatgtcaaggccaaaattcaagacaaggaaggaattccaccagaccaacaaaggctgatttttgctggtaagcagcttgaagatggccgtacccttgctgactataacattcagaaagagtcgactctgcatttggtactgaggcttcgtggtggaattattgaaccatctttgatggctttggctaggaagtacaatcaggacaaaatgatttgccgcaagtgctatgctcgtttgcatcctcgtgctgtcaattgtcgcaaaaagaagtgtggccacagtaaccagttgaggcccaagaagaagatcaagtagatggtgattttgaagtcctttcaacatgtagctgctaatgttgagatccttaagaaaattattagatatgttgttgggttgcctgttcaatttactataaaatattgatggatatgtttttgagctactttcatatttcttaatgagctagattctgatggtttcattacc

SEQ ID NO: 503 - DNA, 694 bp, Artificial Sequence
  Synthetic
ttgctttctctctctctgtctctctctttctgtctaccctttctctctctgtcctctgtttgagccaagaagaagatgcagatcttcgtgaagaccctgaccggcaagaccatcaccctcgaggtcgaaagctccgacaccattgacaacgtcaaggccaagatccaggacaaggagggaatcccccctgaccagcagcgcctcatctttgccggtaaacagctcgaagatggccgcacccttgccgattacaacatacagaaggagtctaccctccaccttgtccttcgcctcaggggcggtatgcaaatcttcgtcaaaaccctcactggcaagaccattacccttgaagtcgagagttctgataccatcgataatgtgaaagccaagatccaagataaggagggaattccccctgaccagcagcgccttatctttgctggtaaacagcttgaagatggccgcaccctcgctgattacaacatacagaaggagtctaccctccaccttgtccttcgcctcaggggtggtatgcaaatcttcgtcaaaaccctcaccggcaagaccattactcttgaagtcgagagttctgacacaattgataacgtgaaagccaagatccaagataaggagggaattccccccgaccagcagaggctcatctttgctgggaagcaacttgaagatggtcgca

SEQ ID NO: 504 - DNA, 1115 bp, Artificial Sequence
  Synthetic
  misc_feature (544)..(544): N at this position can be a, c, t, or g.
  misc_feature (575)..(575): N at this position can be a, c, t, or g.
atacaaacacttctcacatctcttccaccctaaggaatatccgttaacagcgcatcttcttgcactctctacgaatctcccagcggccaacgcttaatccgccaccatgcaaatcttcgtcaagaccctcaccggcaagaccatcaccctcgaggtcgagtcttccgataccatcgacaatgtgaagtccaagatccaggataaggaaggcattcctcctgaccagcagcgtctgattttcgctggcaagcaactcgaggatggccgaactctgtccgactacaacatccagaaggagtccaccctccacctggtcctccgccttcgtggtggtatgcagatcttcgtcaagaccctcactggaaagaccatcaccctcgaggtggagtcatctgataccatcgacaacgtcaagtccaagatccaggacaaggagggtatccctcctgaccagcagcgactgatcttcgctggtaagcagcttgaggatggccgaaccctctccgactacaacatccagaaggagtccactctccaccttgtnccttcgtctccgtggtggtatgcagatcttncgtcaagacgttgaccggcaagaccatcacattggaggttgaatcatcagacaccatcgacaatgtcaaatcaaagattcaggacaaggagggtattcccccggatcagcagcgtcttatctttgctggcaagcagcttgaggacggtcgcaccttgagcgactacaacattcagaaggagagcacacttcaccttgtcctccgtcttcgtggtggtatgcagattttcgtcaagactctgaccggcaagacaatcaccctcgaggtggaatcttccgacaccatcgacaacgttaagtccaagattcaggacaaggagggcattcctcctgaccagcagcgcttgatctttgctggtaagcagctggaagacggtcgcaccttgagcgactacaacatccagaaggagagcacactgcacttggtcctgcgtctgcgtggtggccagtaaatgtgtcttttgcttacgaccgcactgttacgactgaattggacggttgggcgtttttgggaactttttttcaaagcagatatgggaac

SEQ ID NO: 505 - DNA, 668 bp, Artificial Sequence
  Synthetic
cccggaccttgctccacacccgcagcagcagcagcagcaaggagaagaagaagagccaagatgcagatcttcgtgaagaccctaacggggaagaccatcacgctcgaggtcgagagcagcgacaccatcgacaatgtcaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttattttgatgacataattgactacaaagtcaaggttatatggtccggccttaatttttgtccccttcg

SEQ ID NO: 506 - DNA, 762 bp, Artificial Sequence
  Synthetic
gaattcggaggatcttcttcaattctccttcaagatgcagatctttgtgaaaactcttactggtaagaccatcacccttgaggtcgagagctcagacacaattgacaacgttaaggctaagattcaagacaaggaaggaattcctccagaccaacaacgtttgatcttcgccggaaagcagttggaagatggaagaactttagctgactacaacatccagaaggaatcaactctccatcttgtccttcgtcttagaggtggtatgcaaatctttgtcaaaaccttgactggtaagaccatcactttggaagtcgagagctctgacaccattgataacgttaaggctaagattcaagataaggaaggaattcctccagaccagcaacgtttgatcttcgccggaaagcagttggaagatggtcgtactcttgccgactacaacatccagaaggagtctactctccatttggttcttcgtctcagaggtggtatgcagattttcgtcaagacccttactggaaagaccatcaccttggaggttgagagttccgacaccatcgataatgtcaaggctaagattcaagataaggagggtatccccccagaccagcaacgtttgatcttcgccggaaagcagctggaagatggtcgcactcttgccgactacaacattcagaaggagtctaccctccatttggtgcttcgtcttagaggtggtatgcaaatcttcgtgaagaccttgaccggaaagaccatcactct

SEQ ID NO: 507 - DNA, 665 bp, Artificial Sequence
  Synthetic
gaattcataatcgatcagattcttctaggcagtcttattcggcgatctaacctaaatttcttcgacacctctctgaagatgcagatttttgtgaaaaccctcactggcaagaccatcacacttgaggttgagagctcagacacaattgacaacgtgaaagctaagattcaagataaggaaggaattcccccggatcagcagaggttgatctttgctggcaaacagttggaagatggaagaactctagctgactacaacatccagaaagaatccactctccatctcgtcctccgtctcagaggtggtatgcaaatatttgtgaaaaccctcactggcaagaccattactttggaagtggagagttctgataccatcgacaatgtcaaggccaagatccaagataaggaaggtattcctccagaccagcagaggttgatttttgctgggaagcagttggaagatgggcgtacccttgctgactacaacatccagaaggaatccacccttcacctggttctacgactaagaggtggtattgcagatctttgtgaaaacgcttactggaaagaccatcaccttagaagttgagagttcagataccattgacaatgtaaaagccaaaattcaggacaaggaaggtattcctccagaccagcaacgtttga

SEQ ID NO: 508 - DNA, 618 bp, Artificial Sequence
  Synthetic
ggaaaaaggaagccggagctcgtaacgaaaatgcagatattcgtgaaaactctcactggtaaaaccattactctcgaagttgaatccagtgatacaatcgacaatgttaaagccaaaatacaagacaaagaaggaattccaccggaccaacaaaggctgatttttgctggtaagcagctcgaagatggacgcaccttggccgattacaacatccaaaaagaatcgactctacatttggtgctgaggcttcgtggtggaatcattgaaccatcgttgatggctttggctaggaaatacaatcaggacaagatgatatgccgcaagtgctatgctcgattgcatccccgtgctgtcaattgccgcaagaagaagtgtggacacagcaaccagttgaggcctaaaaagaagattaagtagatgtaaatttctattgctgcggacttgtagttgttggcggtattagatctttcagaaactgaacttggatttcttaccaaaaaaacaaattgtacttgggtttatctttgggtttctgttctttttaccccttaagattcatggcttgtatttgggaggtaaatgaaatcaatcagtatactataattgctattttgcttt

SEQ ID NO: 509 - DNA, 1156 bp, Artificial Sequence
  Synthetic
gcaaaaatattcttctgcttttccttctctaagaagcgttggattcccaaaaaccgtttcaaagatgcaaatcttgtaaagaccctcactggcaaaaccatcactctcgaggttgagagttcagacactatcgacaatgttaaggcaaagatccaagataaggaaggaattcctccagatcagcaaaggttgatctttgctggaaagcagttagaggatggccgaactcttgctgactacaatatccaaaaggagtctaccctccaccttgtccttcgtctgcgtggtggtatgcagatctttgtaaaaactttaacagggaagactatcactctcgaggttgagagctcggacacaattgataatgttaaggcaaagattcaggacaaggaaggcattcctccggatcagcaaagattaatattcgccggtaaacagctagaagatggccgtaccttggccgattacaacattcagaaagaatcaacccttcatttggttctccgtttaagaggtggtatgcaaatctttgtcaagactctgactggcaagaccattactttggaggttgagagctctgacactattgacaacgtcaaagcaaagatccaggacaaggaaggaatccctccggatcagcagagacttatctttgccggtaagcagcttgaagacggaagaactcttgctgactacaacattcaaaaggagtcgacccttcatttggtgcttcgtctcagaggtggtatgcaaatctttgtcaagaccctcactggtaaaacaatcacccttgaggttgagagttcagacaccattgacaatgtcaaagctaagatccaagataaagagggaattcctccggatcagcagaggcttatctttgccggtaagcagctcgaagatggacgcacccttgcagattacaacatccaaaaggagtcgacacttcatcttgtgcttcgtctccgtggtggtatgcagatctttgtgaagacccttaccggaaagaccattactctggaggttgaaagctcagacaccatcgataatgtcaaggctaagattcaggacaaggaagggatcccaccagaccaacagagactcatcttcgctggaaaacagcttgaggatggtcgcacacttgcagattacaaca

SEQ ID NO: 510 - DNA, 595 bp, Artificial Sequence
  Synthetic
cccacgcgtccggggtaaactgaagagtgcgccgcaaaatgcagatcttcgtgaaaaccctaaccgggaagacaatcacgctcgaggttgaatcgagcgacaccattgataatgtcaaggctaagattcaagacaaagaaggtattccaccggaccagcagcggttgatattcgccggaaagcagctcgaagatggacgtactcttgctgattataacatccagaaagagtcaactttgcatttggttttgaggcttcgtggagggattattgagccttctctgatggctttggctaggaagtacaaccaggataagatgatttgtcgcaagtgctatgctcgcctgcatcctcgtgctgttaactgcaggaagaaaaaatgtgggcacagcaaccagctgaggccaaagaagaagatcaagtagacgtgatgtcttttctaagcttagatcaattttgcgcgttgcagctatatattgccagtccgttgtttttacagttttcagtcctgcttcaatttgatgtcatggataacaaacatgtcttaaacatctaattattggataagatatctttgtgcactcaatatatgtct

SEQ ID NO: 511 - DNA, 1155 bp, Artificial Sequence
  Synthetic
  misc_feature (489)..(489): N at this position can be a, c, t, or g.
tcattatctcctcaacttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacagttggaagacggcagaaccctagccgactacaacattcagaaggaatcaactcttcacttggtactccngtcttagaggaggcatgcaaatcttcgtcaaaaccctaaccgggaaaacaatcacccttgaagtcgaaagctttgacacaattgacaatgtcaaggcgaagattcaggacaaggaaggaatcccaccagatcagcagaggttgatctttgcgggtaagcaattggaagatggaaggaccttagctgattacaatattcagaaggagtccaccctccatttggtgctccgtcttcgtggtggaatgcagatttttgtgaagactttgaccgggaaaacaatcactcttgaagttgaaagctcagatactattgacaacgttaaggccaagatccaggataaggagggtatcccaccagatcagcaaaggctgatctttgctggcaagcagttggaagatggtcgtactcttgctgattacaacattcagaaggagtcgactttgcaccttgtcctccgtctccgtggtggtttctaaagtgtccgtcagtggtggtggtgatgtctgtgtctgtgtcttgggtctttggtctgtttggtgtttgtttgattcatgatttagtactttgtgtagtttctgttagttgttatcatgttatctttccaatagaggcgaggagtcttgttttcttctgtctctgtttgtgaataataaagtcgaattattg

SEQ ID NO: 512 - DNA, 644 bp, Artificial Sequence
  Synthetic
ttacaatatccagaaggaatccaccctccacttggttctcaggctccgtggtggtatgcagattttcgttaaaaccctaacggtaaagacgattactcttgaggtggagagctctgacaccattgacatcgtcaaggccaagatccaagataaggagggtattcctccggaccagcagaggttgatcttcgccggaaagcaacttgaggacggcagaactttggcggattacaacatccagaaggagtctacgcttcatttggtcttgcgtctgcgtggaggtatgcagatcttcgtaaagactttgaccggaaagaccatcactcttgaagttgagagctccgacaccattgataacgtgaaggctaagatccaggacaaggaaggcattcctccggaccagcagcgtctcatcttcgctggaaagcagcttgaggatggacgtactttggccgactacaacatccagaaggagtctactcttcacttggtcctccgtctccgtggtggtttctaaaccttgtctctctctcttatggttactgaaccaagttcatgtatcgtttcatctagtactttggtggtttatgttttggggccatgtacagcctctgataaataattgatcgactatgtttccgtta

SEQ ID NO: 513 - DNA, 196 bp, Artificial Sequence
  Synthetic
ttcgccggaaaacaacttgaagatggcagaactttggccgactacaacattcagaaggagtccacactccacttggtcttgcgtctgccgggaggtatgcagatcttcgtgaagactctcaccggaaagaccatcactttggaggtggagagttctgacaccattgataacgggaaagccaagatccaggacaaag

SEQ ID NO: 514 - DNA, 313 bp, Artificial Sequence
  Synthetic
aaaaccctcaccggaaaaaccataaccctagaggtcgaaagcagcgacaccatcgacaatgtcaaagccaaaattcaggacaaagagggaataccacctgatcaacagaggttgatatttgctggtaagcagcttgaagatggtagaacattagcggattacaacattcagaaagaatcgactcttcacttggtattgaggcttaggggtgggactatgattaaggtgaagactctcacagggaaggaaattgagattgatatcgaaccaaccgatactattgatcggattaaggaacgtgttgaggagaaag

SEQ ID NO: 515 - DNA, 306 bp, Artificial Sequence
  Synthetic
cgcggtatgcagatcttcgtgaagactctcaccggaaagactatcactttggaggtagagagctctgacaccattgacaacgtgaaggccaagatccaggataaggaaggaatccctccggaccagcagaggttgatctttgccggaaaacaattggaggatggtcgtactttggcggattacaacatccagaaggagacgacccttcacttggtgttgcgtctgcgaggaggtatgcagaaattcgtcaagactttgaccggaaagaccatcacccttgaagtggaaagctccgacaccattgac

SEQ ID NO: 516 - DNA, 1210 bp, Artificial Sequence
  Synthetic
tcatcaattaggtttcttcgatagcaagtagcgatgcagatcttcgtcaagactctcaccggcaagactatcaccttggaggtggagagctccgacaccatcgacaacgtcaagaccaagatccaggacaaggaagggatccctccggatcagcagcggttgatctttgccggcaagcagcttgaggacgggcgtaccctcgccgactacaacatccagaaggagtctacgctgcatcttgttcttcggctgcgaggaggtatgcaaatattcgtcaagaccctaacgggtaagacgatcaccctggaggtggagagctccgacaccatcgacaacgtcaagaccaagatccaggacaaggaagggatcccgccggatcagcagcgtctgatcttcgctggcaagcagctcgaggatggccgtaccctggccgactacaacatccagaaggagtcgacccttcatcttgtgctgcgtctgcgaggaggcatgcagatcttcgttaagaccctcactggtaagacgatcaccctggaagtcgagagctcggacaccatcgacaacgtgaagactaagatccaggacaaggagggaattcctccggaccagcagcggttgatcttcgcgggtaagcagctcgaggatgggcgcactcttgccgactacaacattcagaaggagtctacactccatttggtgctgcgtcttcgcggaggcatgcagatcttcgtcaagaccctcacgggtaagacgatcaccctggaagtcgagagctcagacaccatcgacaacgtgaagaccaagatccaggacaaggagggaattcctccggatcagcagcggttgatcttcgcgggtaagcagctcgaagatgggcgcactctcgccgactacaacattcagaaggagtctactctccatttggtgctgcgtcttcgcggaggcatgcagatcttcgtcaagaccctcacgggtaagacgatcacgttggaggtggagagctcggacacgattgacaacgtgaagaccaagatccaggacaaggagggaattcctccggaccagcagaggctgatcttcgccgggaagcagctcgaggatggccgcactcttgcggactacaacatccagaaggagtctactctccatttggtgctccgtcttcgtggaggccagtagatagcatgtagcgcgttagcgcgtgaagtat

SEQ ID NO: 517 - DNA, 722 bp, Artificial Sequence
  Synthetic
cgacccacgcgtccgcttttgtgggcgattcctgggtaatttcatacagcggcaactatgcagatcttcgtcaagacactgactggcaagacgatcactctggaggtcgagagctcggacacgatcgataatgtgaagaccaagatccaggacaaggaagggatccccccggaccagcagcgtctcatcttcgccgggaagcagctcgaagacgggcgaatcttggctgactacaacatccagaaggaatccactctccatctcgtcctacgtcttcgcggaggcatgcagatctttgtcaagacgctgaccggcaagaccatcactctggaggtcgagagctcggacacgatcgataatgtgaagaccaagatccaggacaaggaagggatccccccggaccagcagcgtctcatcttcgccgggaagcagctcgaagacgggcgaaccttggctgactacaacatccagaaggaatcgactctccatctcgtcctacgtcttcgcggaggcatgcagatctttgtcaagacgctgaccggcaagaccatcactcttgaggtcgagagctcggacacgatcgataatgtgaagaccaagatccaggacaaggaagggatccccccggaccagcagcgtctcatctttgctgggaagcaactcgaagacgggcgaaccttggccgactacaacatccagaaggagtcgacccttcacttggt

SEQ ID NO: 518 - DNA, 1003 bp, Artificial Sequence
  Synthetic
ggtgatttctaaacatgcagatctttgtgaagaccttgaccggcaagactatcaccctcgaggtggagagctcggataccatcgacaacgttaagaccaagatccaggacaaggaagggatcccaccggaccagcaacgattgatcttcgccgggaagcagcttgaggacggacggacccttgcggactacaacatccagaaggaatccacgcttcacctggttcttcgtctccgcggtggcatgcagatatttgtgaagaccttgaccggcaagaccatcaccctcgaggtggagagctcggataccatcgacaatgtcaagaccaagatccaggataaggaggggattcctccggaccagcagcgacttatcttcgccgggaagcaactcgaggacggacggacccttgccgactataacatccagaaggagtcgactctccacttggttcttcgtctccgcggtggcatgcagatatttgtgaagacactgaccggcaagaccatcaccctcgaggtggagagctccgacacgattgacaacgttaagacgaaaatccaggacaaggaagggatccctcctgaccagcagcgcctcatcttcgccggcaagcagctcgaggatggacgaactctcgccgactacaacatccagaaggaatccacccttcacctggtgctgcgtctccgcggaggcatgcaaatcttcgtcaagaccctgaccggcaagaccatcacgctcgaggtcgagagctccgacacgatcgacaacgtaaagaccaagatccaggacaaggaagggatccccccggaccagcagcgactcatctttgccgggaagcagctcgaggatggcaggactctggccgactacaacatccagaaggaatccacccttcacctggtgctgcgtctccgcggaggcatgcaaatcttcgtcaagaccctgaccggcaagaccatcactctggaggtggagagctcggataccatcgacaacgt

SEQ ID NO: 519 - DNA, 914 bp, Artificial Sequence
  Synthetic
tccgcaacatctgaagattgcttaggacggcaataggtctattgtcgaggtatgtctgaaagatgctgcatttctatctgccctccatgagctccgggagcttcatgagggaatcatcgttgatgtctccctcttgagcattcttctttgtttcccggagctctattccccaaatcccgagatattgctcgttgtcgcgaagaaatttgcaacacggcaattctcgccttcttctccccaaagtcaactcacgcaggcaatgtatgctgggcaaacaaatctaacccttccagttaggcaagatgcagattttcgtcaagaccctcacggggaagacgatcacccttgaggtggagtcttccgacaccatcgacaatgtcaagtccaagatccaggacaaggagggcattcccccggaccagcagcgattgatcttcgctggtaagcagctggaggatggccgaaccctctccgactacaacatccagaaggagtctaccctccacctggtcctgcgcctgcgtggtggtgccaagaagagaaagaagaaggtctacaccacccccaagaagattaagcacaagcgcaagaagaccaagttggctgtcctcaagtactacaaggtcagcaacgatggtaacatcgagcgtctccgccgcgagtgccccagcgagacttgcggtgctggtgtcttcatggctgccatgcctgaccgtcaatactgtggtcgttgccacctgacctacgtcttcgacaagcagtaaacgacaaaactttcaaaaagggaaaaaatttattgtggattggacagctggagccatgggactgccataacacacaaaggcgttgatgtagcattagagagcacatccggcggcttctggtaatgaatgcttgatttgagacacgtttgg

SEQ ID NO: 520 - DNA, 535 bp, Artificial Sequence
  Synthetic
gcatcacaaaaatcgttcaagatgcagattttcgtgaagaccctgacgggcaagaccatcacccttgaggtcgagtcctccgacacgatcgacaatgtcaagtccaagatccaggacaaggagggcattcccccggaccagcagcgattgatctttgctggcaagcagctcgaggatggccgcaccctttccgactacaacatccagaaggagtccaccctccacctcgtcctccgtctgcgtggtggtgtcattgagccctctctgaaggttcttgcctccaagttcaactgcgacaagatgatctgccgcaagtgctacgcccgtctccctccccgtgccaccaactgccgtaagcgaaagtgcggtcacaccaaccagctccgacccaagaagaagctcaaataaatcatttcaccaaggatgtggcgtctgggttatggcattctggggtggcgaggacagaggtgcttctgctttattccggattttggttctacattagcatcagggcagaggcaaaatatatcaatct

SEQ ID NO: 521 - DNA, 654 bp, Artificial Sequence
  Synthetic
gaccgaaggggagggggagcgaagctttgcgttctctaatcgcctcgtcaagatgcagatattcgttaagaccctcactggcaagaccatcaccttggaggttgagtcctccgatacgattgacaatgtgaaggctaagattcaggacaaggagggcatccctccggaccagcaacgccttatcttcgctggcaagcagcttgaggatgggcgtactctcgcggattataacatccagaaggagtccaccttgcaccttgtcctccgccttcgtggaggcatgcaaatattcgtgaagaccctcaccggcaagaccattaccctggaggtcgagtcctccgacacgatcgataatgtgaaggccaagatccaggacaaggagggaatcccaccagaccagcagcgtctcatctttgctgggaagcagctcgaggatggccgcacccttgcagactacaacatccaaaaggaatccaccctgcaccttgtcctgcgcctccggggcggtatgcagatctttgtgaagacccttactggcaagacgatcaccttggaggttgagtcctctgacacgatcgacaatgtgaaggccaagatccaggacaaggagggtattccaccagaccagcagcgcctcatcttcgctggcaagca

SEQ ID NO: 522 - DNA, 611 bp, Artificial Sequence
  Synthetic
gagagagagagagagagagagaagatgcagatattcgtgaagaccctgacggggaagaccatcaccctagaggtcgagagcagtgacaccatcgacaatgtcaaagccaagatccaggacaaggaaggcatcccccctgatcagcaacgacttatctttgccggcaagcagctggaagatggccggacattggcagactacaatatccagaaagaatccaccttgcaccttgttctgaggctccgaggtggtatcatcgagccttcactgatggcactggctaggaagtacaatcaagagaagatgatatgccgcaaatgttatgcccgcctccatcctcgtgcagtgaactgcagaaagaagaaatgtggacacagcaatcagcttcgccctaagaagaagatcaagtagatttgacgcatccttcggagagattgaggacctataacattagtgagagtgtttttttgattatctattgccagaattgaatttagacactggtctcccatcggaacttttctaatattatataatcagtactttttgttgaaccaatagcgtgttgatcttttcatccttttcaacatatggaattgtgtcggggttaa

SEQ ID NO: 523 - DNA, 659 bp, Artificial Sequence
  Synthetic
cacgcgtcgcccacgcgtcgctcttctcttgtggtatctctctctctctctctctctctctttcctgagaaaatgcagatcttgtgaagaccctgacagggaagaccatcaccctggaggtggaaagctccgacaccatcgacaacgtcaaggccaagatccaagacaaggagggcatcccccctgaccagcagcgcctcatcttcgctgggaaacagctcgaagatggccgtaccctcgctgactacaacatccagaaggagtccactctccaccttgtcctccgcctccgaggtggtatgcaaatctttgtcaaaaccctcactggtaagaccatcacccttgaagtcgagagctctgatactattgacaatgtcaaggccaagatccaagacaaggaggggattccccctgaccagcagaggctcatctttgctgggaagcagcttgaagatgggcggacccttgccgactacaacatccagaaggagtccaccctccaccttgtgctgaggctccgggggggcatgcagatcttcgtcaaaactctaacagggaagacgataacgctggaggtggaaagctctgacacaattgacaatgtgaaggcaaagattcaagacaaggaagggatccccctgaccagcagcgattgatct

SEQ ID NO: 524 - DNA, 582 bp, Artificial Sequence
  Synthetic
acgcgtcggtttgttcttgctgtagggcgcgagatttggatcgatccattgccgccgcgcgatgggtgtgaagattagattcgctcgttttggaaggaaaaagctgcccttctatcgaatctacgtcgcggacagccgatgcaagcgtgacggcagatttttggagaatgtaggctactacaatcccattactggcaaagatggtgagaagcaattcgccatcaagtcggaccgagtcaaatattggatctccgttggagcacagccttccaacgctgttgcgaggcttttggcaagaacaggtaaccttccaacagcgtatcctcaggggccgacgcgatcatcaccatctccttcggcggcgccggcggcggacgacaagccggacatgaccatctccgccaagctctccgcctcgccggctccaatgctggccgccaggacactctgcttctgctgacgacgtagacgtcgacgaatcgagcaagagcaaaatactacaaagaggtttgacatttttatctaaattatttaagttagctctcgaagtaagctctgactcttgatagcgatggagttctt

SEQ ID NO: 525 - DNA, 748 bp, Artificial Sequence
  Synthetic
ctcgagcttgcggccgcctcgcgcgtcttggttgtaaacaccgacccttctatcgtgtagttgtcgccgatgaaaaatcgcgcagggacggtaaacaaatcgaggtgttaggcttttatgatccactccaaggcaaagaagatgcggatagagtgagcctcaaattcgacagaatcaagtactggttatctgttggagctcaaccaacagacacagtggaaagcatgcttttcagggccggtttgataccaccaaagcctatggtagtggtcggttcgaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgttggttaagacgcggccgcccgtattatacataaaatctcatgtatctttacatcaaacttcaaatctaaatacaaaaacaaaaagaacatcactagagatggatctctcgtcggacaaaaccccgaagtttcgtctttcacggtcaactttagtcaaactccgatccgaatcaaaccaaaaagggtttttcattcatcgatcatagtcatcatctcctttttagacaaaagattctcagcttctctggatcat

SEQ ID NO: 526 - DNA, 534 bp, Artificial Sequence
  Synthetic
  misc_feature (482)..(482): N at this position can be a, c, t, or g.
ttcttggccatagccgtatatacgagctgagaaatcgtcaaaatgtgtggtggatcgatcatttcgaccttgtcgcttcctgataggggtaaggcctccctcgccaaacctcctcttcttaccttcccccctgatgatgacttggaatggctctgtggcctgcctgaatccgaatccatcaatgatgacggattcttccgcaaatttctcgattccaatagtgaactgcagcaggacatagctggcgtctttcctgatctgtgctctcccggtcttgacaattctgaagaggtcattcctgttcccactcccgctcccgctcccgtgaaaagtaggagtaggaagcacctgtaccgaggcatccggcagaggccttgggggaaatgggctgcagaaattcgtgaccccaaaaagggtgtcagggtctggcttggcacatttgaaacagccgaagaagctgcccgtgcctatgataccgcagnccgaaagatcaggggcagcaaggccaaggttaatttcacccaagaaatcccc

SEQ ID NO: 527 - DNA, 725 bp, Artificial Sequence
  Synthetic
  misc_feature (595)..(595): N at this position can be a, c, t, or g.
cccgatcacaagctcacaagttcagggcccaacacccaaaagcaaaagaaaagcagcaaccaaagatgtgcggcggagcgatccttgcggagctcataccgagcgcgccggcggcgaggcgcgtcacggcgggccacgtctggccgggcgacgccaacaatgccaagaagaagggcgcgcgcgccgacgacttcgaggccgcgttccgcgacttcgacaacgactccgatgacgaggagatgatgctggaggaggcggaggaggaggaggcgacctccgagcacaagccgttcgtcttccgcgccaagaaggcgaggaaggcggcggcggcggcggcgtcgagcaggcgcaggaagccggcgcagtacaggggcgtgcggcgccggccgtgggggaagtgggcggcggagatccgcgaccccgtcgagggcgtccgcgtctggctcggcacgttcgccaccgccgaggccgccgcccacgcctacgacgccgccgcccgcgacctccgcggcgcgaccgccaagctcaacttcccctcctcctcctcctccaccgccgccaccccacgcccccgcaagtgccgccccaccaccgncaccgccacccccaaggcgacgacaccgaacgtcgtcgtcgtcgtcaacctcgtcgacaaagaggccgaggtcagcgagagctccggtgccagcagcagcgcgctgccggacttctcgtggcacggcatg

SEQ ID NO: 528 - DNA, 724 bp, Artificial Sequence
  Synthetic
gcagcatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaa

SEQ ID NO: 529 - DNA, 395 bp, Artificial Sequence
  Synthetic
gcagcatgcccctctcgtcaccaaggccaagggccgtaaactcacggctgaggaactctggtcagagctcgatgcttccgccgccgacgacttctggggtttctattccacctccaaactccatcccaccaaccaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgacgttgcggccaagcagatccgtggtgataaagccaagctcaacttcccagattgcaccatcctcctcctcctaa

SEQ ID NO: 530 - DNA, 385 bp, Artificial Sequence
  Synthetic
gcagcatgcccctctcgtcaccaaggccaagggccgtaaactcacggctgaggaactctggtcagagctcgatgcttccgccgccgacgacttctggggtttctattccacctccaaactccatcccaccaaccaagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagattgcaccatcctcctcccctaa

SEQ ID NO: 531 - DNA, 290 bp, Artificial Sequence
  Synthetic
aggaggaggaggcgacctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgc

SEQ ID NO: 532 - DNA, 661 bp, Artificial Sequence
  Synthetic
cccacgcgtccggaaaaaagaaaaaagattactccgtcaaagacgaaactgatttctgcaaaaaacttttctgctgagagaaaacataaagcatgtgtggtggtgctataatctccgattacattgctccgagccggacttctcgacggctcaccgccgagttgctatggggccggtccgatctgagtaagaagcaaaaaaatcctaccgattatcactccaagccgttgagatcccaagtagttgaccttgacgatgacttcgaggctgattttcaggacttcaaagatttctccgatgatgaggaggttgaagtcgatgtcaagccatttgccttctctgcttcgaaaacctgtacttttgaaggctccaaatctgtgaaaactgtttattcagacaaggatgctgatagatcctctaagagaaagaggaagaatcagtatagggggatcagacagcgaccttggggtaagtgggcagctgaaatacgtgacccaagaaaaggggttcgggtctggttgggaactttcaatactgcagaagaagctgccagagcttatgatgtcgaggcaaggaggatcagaggcaataaagccaaggtaaactttcccgatgaagctccagtgcctgcctcaagacgtactgttaagctgaatcatca

SEQ ID NO: 533 - DNA, 644 bp, Artificial Sequence
  Synthetic
  misc_feature (554)..(554): N at this position can be a, c, t, or g.
  misc_feature (604)..(604): N at this position can be a, c, t, or g.
agcagcagcagcgcatttcgagagcagaggaagaaaatgccggcaggtcacggattgaggtctcgtacgagagattcattctctcgcgcattcagaaagaagggtaccatcccactttccacctacttgaggattttcaaaattggagattatgttgatattaaggttaacggcgccatccacaaaggaatgccacacaagttctaccatggtcgcactggtcgtgtttggaatgtcaccaagcgcgccgttggtgtcgaagtcaacaagcaggttcgtaacaaaatcttaagaaagaggatccatgtgaggattgagcatgttcagctttcacgatgcactgaagaagtcaaagaaaggatgaagaagaacgatcaactaaaggccgaggcaaaagctagaggagaagtcatcagcacaaaaaggcaacccgtgggacccaaaccaggtttcatggttgaaggtgctacgttggagacagttactcccataccatatgatgtggtcaatgatttgaagggaggttattgatcttagtctgtttcggaggtggntgtttgttctatctgcttttctgaaactgaaagacaggattatagtttgnttggtgtcacctgcagatttcgcttgttagtttaaatttt

SEQ ID NO: 534 - DNA, 540 bp, Artificial Sequence
  Synthetic
ggtcttagtagcagcagggaaaaggggaagggaaaggggaagggaagggaaagatgccggcaggacatgggctaagggctcgaactcgggatctgttctcccggcccttccgcaagaaggggtacatctcgctgacgacgtacctgcggaactacaagataggggactacgtggacctgaaggtgaacggggcagtgcacaagggcatgccccacaagttctaccacggtcggaccggtgtcatctggaacgtcaccaagagagccgtcggtgttgacatcaacaagcaggtaaacaccaggattatcaagaaaaggattcatgtgcgaattgagcacattcatccatcacgctgcagggaagatttcattgcgcggaggaataagaacgaggagcttaaaactgaagccaaagctcgaggtgaaaagatagccccaaggcggcagcctgcgggtcctaaacctgcatccatagtagaaggtgctactctagagacagttactccgattccttatgatgtggttaatgatcagaagggag

SEQ ID NO: 535 - DNA, 631 bp, Artificial Sequence
  Synthetic
ctagggttttagttgtcgcacgaggtggaaaaatgcctgcgggtcatggagttcgggcgagaacgagggatctgttcgcgaggccattcacgaagaagggttacattccactctcgacttacctgagaaccttcaaggtcggcgattacgtcgatgtgtgtgaatggtgcgatccacaagggtatgcctcacaagttctaccacggtcgtactggtcgtatctggaacgtcactaaacgcgccgtcggtgttgaagtcaacaaacagattggcaacaggatcataaggaagaggattcatgtgcgtgtggagcatgtgcagcaatcaagatgtgctgaggagttcaagctgaggaagaagaagaatgatgagctcaaggctgcagccaaagccaatggtgagaccatcagcaccaagagacagcctaaaggacccaaaccaggattcatggtcgaaggaatgaccttggagactgtcactccaatcccctacgatgtcgtcaacgatctcaaaggaggctattagttctatcttcttgtgctttagaactctttttcatatgttttgtagcagacttaaaactaagaattatgatttactatataacaggagtttgcaatcccaaaaaaaa

SEQ ID NO: 536 - DNA, 611 bp, Artificial Sequence
  Synthetic
acaagagatctgttcggcgagaccattcaggaagaagggttatattccactctccacttacctcagaaccttcaaggtcggcgattacgtcgatgtcaaggttaatggagctatccacaagggtatgcctcataagttctaccatggtcgtactggtcgcatctggaatgtcactaaacgtgccgttggtgttgaagtcaacaaacagattgggaacagaatcataaggaagaggatacatgtgcgtgtggagcatgtgcaacagtcaaggtgtgctgaggagtttaaactcagaaagaaacagaacgatgtgcttaaggctgatgctaaagccagaggtgagactatcagcaccaagagacagcctaaaggtcctaaaccgggtttcatggttgaaggtatgacattggagactgtcactcccattccttacgatgttgtcaacgatctcaagggtggttattgagttgtttccattttattatcattctctactcagaatttttgcacttgcttttttaatgatgtttttgtatcaaacaagagtgaattctatatggtatgagttcatattttgttaggaaagatggtttatcccaatcaaaaaaaaa

SEQ ID NO: 537 - DNA, 573 bp, Artificial Sequence
  Synthetic
gcatcgatctcgtcgagaagaagcgcattccacgatgccggcgggtcatgggcagaggtcgcggacgagggatctgttcgccagggccttccggaagaagggcccgatcgcgcttaccacatacctgcgcacattccggatcggcgactacgtggatgtcaaggtgaacggcgccatccacaagggcatgccgcacaagttctaccacggccggactggagtcgtgtggaatgtcaccaagcgcgcgatcggcgtcgagatgaacaagcaggtggggaacaggatcatcaagaagcggctccatgtccgcattgagcacgtaaagccatcgcgctgccgtgaggatttcctgaagcgggtcaagagcaacgcagaggccaagaggagtggcgtcaagactgcgctcaagaggcagcccgagggaccaaagcccggcttcatcgtcgagggcgcgacactggaaactgtgacccccgtcccctacgatgttgtcaacgatctcaagggcgggtactgagcgccagttctcgttattgtgctttccatttcatgtaatacaagttttggttgctt

SEQ ID NO: 538 - DNA, 508 bp, Artificial Sequence
  Synthetic
gcagaacccgatacatgttctctcgggacttcaagaagaacggaactatccccatgtccgtctacttgaagacctacaaggttggagacattgttgacatccgagccaacggttccatccagaagggtatgccccacaagttctaccacggccgaactggaatcgtctacaacgtgaccaagtccgctgttggcgtcatcatcaacaaggttgttggcaaccgattcatggagaagcgaatcaacctccgaatcgagcacatcaagcactccaagtgccgacaggagttccttgaccgagtcaaggccaacgatctcaagcgaaaggaggccaaggccaagaacgagattgtccagctccgacgacagcccggcgccacccgagaggccaagacccttgccatcgacgagaccaactaccctctcaccgttgctcctcttgcttacgagactttcatctaagcggtcgagagtgacataataaaattgtatcttattaaaaaaaaaag

SEQ ID NO: 539 - DNA, 354 bp, Artificial Sequence
  Synthetic
cgacggcaatcaggcgcgatgggtcactcttacggaaagcgagcgggcacccgatatgccttcagcagggacttccgccaaaagggcatgatcgccctgaacacctacctgaaggtgtaccacgtcggtgacattgtcgacatcaaggccaacggtgctgtccagaagggtatgccctacaaggtctaccacggcaagactggcgttatctacaacgtcaccaagagcgccgtcggcatcatcatctacaagaaggtcaagcaccgctacatcgagaagcgcatcaacgtccgaatcgagcacatccagccctctcgatcccgtgaggacttcatcaagcgagtcaaggcgaac

SEQ ID NO: 540 - DNA, 601 bp, Artificial Sequence
  Synthetic
  misc_feature (221)..(221): N at this position can be a, c, t, or g.
tctaccgacgccgccgccaccaccgccaccgccgcagcagaagcagcgcagccgcaggagggaagatgccggcggggcacgggctgcgggcgcggacgcgcgacctcttcgcgcggccgttccgcaagaagggttacatcccgctcaccacctacctgaggacgtacaagatcggcgattacgtcgacgtcaaggtgaacggcgccgtgcacaagggcatngccgcacaagttctaccacggccgcaccggccgcgtctggaacgtcaccaagcgcgccatcggcgtcgagatcaacaagcaggtcggtaaccgcatcatcaggaagaggatccatgtccgtgtggagcatgtccagccatccaggtgcaccgaggagctccgcctgaggaaaatcaagaacgatcagctcaaggctgatgccaaggcccgtggtgaggttatcagcaccaagagacagcccgagggacccaaacctggtttcatggttgagggtgctacgctggagactgttacccccattccgtatgatgtggtcaatgatctcaagggtggttactagaatgcttgtttcttgaactggagaatccaattagcgtcta

SEQ ID NO: 541 - DNA, 650 bp, Artificial Sequence
  Synthetic
cgctcttcacagaaaacacacgcagagcacttcgcagaggaaaatgccggccggccatggattaaggtctcggacgagggattcattctctcgcgccttcagaaagaagggagtaatccctctttccacctacctcaggatcttcaaagtcggtgattatgttgatgtcaaagtgaacggcgccgttcacaagggcatgccccacaagttctaccatggccgtactggacgcgtctggaacgtcaccaagcgcgctgttggtgtcgaagtcaacaaacaggttcgtaacaaaatcctccgaaagaggatccatgtgaggattgagcatgttcaactttcccggtgcaccgaagaagtcaaggaaagaatcaagaagaacgatcagctaaaggctgaggctaagactaggggtgaggtcatcagcacaaagaggcaacctcaaggacccaaaccagggttcatggttgaaggtgctactttggaaactgttactcccataccatatgacgtggtcaacgatttgaagggaggctattgattttactttgattctgagcttgtttttttctccctatgtgctgttatgacgttgagactactagttattctcggcatcagttgcaaaattgcattttagttccaaattttac

SEQ ID NO: 542 - DNA, 663 bp, Artificial Sequence
  Synthetic
  misc_feature (132)..(132): N at this position can be a, c, t, or g.
aagagggaagaggagaaggagtagtagtaggggaggggagtagaagaaggaaggaaggatgccggcaggtcatggacttagggctcgaactcgggatctcttctcccggcccttccgccggaagggttacantttcactgacgacgtacctccgcaactacaagatcggcgactacgtggacctgaaggtgaacggtgctgtgcacaagggtatgccccataagttctaccatggccgtaccggtgtcatctggaacgtcaccaagagggctgtcggtgttgagatcaacaagcaggtcaacactaggatcgtgaagaagaggattcatgtgcggattgagcacatccacccatcacgatgcagggaagacttcattgcaaggaggaagaagaatgaggaactaaagacagaagctaagaagaaaggagagaagatagcacctaggaggcagccggaggggccaaaaccgggattcattgttgaaggtgctaccctagagactgttacacctattccatatgatgtcgtcaatgaccagaagggagggtactagaactagagctgccttcttgtctcatttcttaaatagagaactactccggcataataggatggttgccactctctgtctagtcacttactggcttttgaaccttagcggc

SEQ ID NO: 543 - DNA, 638 bp, Artificial Sequence
  Synthetic
  misc_feature (603)..(603): N at this position can be a, c, t, or g.
tcctgtctctctcatcttcatcttcatcttcatgttcttcaatggccaagagtgggtcccatttcttcactggccaggcttctccatctctcctcaggctatcatgcaagccggtaattgcgcctgtgtctaggtgccgagtaatttgtgcagtcacccccaagaaggttgattctgcagtaaagagagttcgccaagcagtaaagaaacgcctcaacaataagtctcgcaagtcagaaatattcacacgcatgaagaaggtgtttgctgcaatagatggtttgaaaaagcaaagtgaggcttctcctgatgatattctaccggttgagaaactcattgcggaagcgtattcggtcattgacaaagcagccaaggttggaacaatccatcgcaacacagcggcacggaggaagtctcggcttgcacgggcgaagaaagcagcctctttgcagcttggcttttatacaccaacggcagcgtgaatgaccttaaatatagataacaattcaacaagaactgttattcaatcaaatcggttttatccttgattttagtattaccatgtctgatgtaaagtggcaaatacttttccttcagtttatngtgagttcaagaaattagaaaatgtgacagtttat

SEQ ID NO: 544 - DNA, 688 bp, Artificial Sequence
  Synthetic
aatcgaagagtctgaaagcgactaaatgtacattataaagaaacagattttgattttgaaagatctgggaacaaaaacaaatttccgttatccccatgttcttatgcagccatgggcacaacttctgatggtgctgcagcaactgcgtctgggacgtaccaaccatggtgaatttcaacggcttttttcctcctagccaatcgagacttcctacgggcaccattgttcttgtgtaatgctttaaccttaactgctttgtcaattgcagaataagcctctcctatcagtttctccaccgtcacaatctcatcatcttgcgcatcacttttcttcttgaacccctcaagtgctttcaagaccttcttcatccgggtacgggcttcagatttcttagatttgttgaaaacacgcctcttctcagcttggcgagctctctttgcagctgaatcagctttcttggtaggagcagcagcctcacacacaatcaattgcctcattggcttctgtacccacaaattcccggttgagaaggcgacgcattgagaaacgctctgagagaagctaagggaagaggataaggtagccgaagcaccacgacgattggagaaggaagaagatggtgacgaacaagagattcccttaagcgaaaggactttgaattgggattcgagggtcgcacaggaagaaa

SEQ ID NO: 545 - DNA, 625 bp, Artificial Sequence
  Synthetic
aaagcaagtaagggccgccattaggattttggtagaaccctaacaaaaatagtaaggtcctaagtaacaggggacatggatatgcaaagcgagttcgatcgcctcctcttcttcgagcacgctcgtaagactgccgaaactacctacgctcagaatcccctggatgctgataacttgacgagatggggaggtgcgttattggaattatcacagttccagcccgttcctgaatcaaaacagatgatttctgaggcaacctcgaagttggaggaggcattggaggttaatcctgaaaagcatgaaactctttggtgtttggggaatgcacatacatctcatgcgtttttaactcctgatatggaagaggctaaggtttactttgacaaagcaactcagtgctttcagcaggcagttgatgcggatccaggaaatgacatttactgcaagtctttggaagttacctctaaggctccagagttgcacatggaaatccacaaacagggttccatgccacaagctatgggaccagagccatcaacatcgacaagcacaaagagttcaaaaaagaagaagagcagtgatctcaagtatgacatttttggatgggtaatacttgcagttggta

SEQ ID NO: 546 - DNA, 508 bp, Artificial Sequence
  Synthetic
ccccccggtcctccgtcctcctctctctccccaaatcggacatcgagagagagagagagagaggtctaaaaccctaacccccgaatcgaatctcgtcggaagccgccgccgccggcgccgccgacgacgacgcccgcgacgccatggacatgggagcgatgagcgatcctgagaggatgtgcttcttcgacctggcatgccagaacgccaaggtcacctacgaacagaacccgcacgaggccgacaatctcacgcggtggggaggcgcgctgctcgagctctcgcagatgcggaacggccccgagagcctcaagtgcctagaagatgcggaatccaagctggaggaagcactgaaaattgatcccatgaaggcggatgcgctttggtgcttgggaaatgcacagacctctcatggattcttcacttcagacactgtcaaggccaatgaattctttgaaaaggcaacccagtgtttccacaaggctgttgatgtggaacctgcgaatga

SEQ ID NO: 547 - DNA, 595 bp, Artificial Sequence
  Synthetic
agggactacatggagcggctcattttcgtcgaggcgacgagggagaaggccgccgagagctacgggcggtctccggaggacgccgattatctgacgcgatggggcggggcactgctccatctatcgcattttcgccagggacaagaccaacttaacatgatcgaagactccgagtctaagctccgggaggccctctcgatcaatcccaagaagcacgagacgcactggtgcttgggcaatgcttacaccgcccatggtttcttgctgccggagactggcaaggccaacgagtacttcaaaaaggccacagattgcttcaagagagcagtggacgaggattccgacaatggcctctacatgaaatcactggaaatggccgcaaaggggcctcctgtgtacttagagttgcaaaagcagatgctcacccagcaactcggcctcggcggcagcagcagtggcatcggcagcggcggcggtggcggacacctctccgggaaggcaaagaataagaagccaaacagcgacttcaagtacgacgttcttggctgggcggtgctcgttctgggagtcttcgcgtggctcgggatggcaaaga

SEQ ID NO: 548 - DNA, 169 bp, Artificial Sequence
  Synthetic
cccacgcgtccgatagcgtctctgatgcctagcacatgattcaggaggccatcacaaagtttgaagaggcattgttgattgacccaaacaaagatgaagcggtttggagtattgggaatgcatacacttcatttgcgcttctgactcctgacgagactgaagctaaaca

SEQ ID NO: 549 - DNA, 621 bp, Artificial Sequence
  Synthetic
gagagagagagagagagagccattgtcgctgccatgtctaaccgcgaaggagagagagtcaggttgtacgtccgaggaagcatacttggctacaaaagggccaagtcaaaccagtatcccagcacttcactggttcaggttgaaggtgtgaacaccactgaagaagccaattggtacttggggaagagggttgcctatgtttacaaagcaagaaccaaaaagaatggaaccctctaccgctgtatttggggaagagtgaatagaccccatggtaatagtggagtggttcgagccaagttcaccagtaacttgcccccctgctccttgggtgcaaaagtacgagtattcatgtacccgagccgcatttgaggagcagtgaagccaggttccacaggcttcggctgggcttttttgatttgtgctagattcatttcgcattgcgtttggacaatgcgggtcggctctcttactttctatgcctaaaaacaatatgttccgttcacttaactatatgatgagtccttaggttgaaaggaatactgctgctttctgcctagtttgtcatctatcttggaacattatgacttcggaatacatgccatttaggtttttttccccttc

SEQ ID NO: 550 - DNA, 577 bp, Artificial Sequence
  Synthetic
gaattcaaaggcgattttcttcatttacagcaaagatggtgaaaggtcgtgaaggtgaacgtatcagactctacgtcagaggaaccattcttggatacaagaggtcaaagtcgaaccagtacccaaacacatcgttggttcagattgaaggagtgaacaccaaagaagaagtacaatggtatgctggtaagagggtggcttacatctacaaggctaaggtcaagactaatggttctcactaccgatgcatttggggaaaagttatcaggcctcacggtaacagtggtgttgttcgtgctaaattcacctccaacttgccacctaaatccatgggaatgagagttagagttttcatgtacccaagcaacatctaaggttgaagattactacttgtggtggtgaagttctacattgcgagctttagtgttccgatattggtagtattcagtttaagttttcttatttagaactatcttttgtagttggtaaacaaattggaagttactttaagtttgaaaagaaagcttttgtgtcggtgctttcagattaattttaaatgctattatacttttcagtc

SEQ ID NO: 551 - DNA, 681 bp, Artificial Sequence
  Synthetic
  misc_feature (263)..(263): N at this position can be a, c, t, or g.
  misc_feature (445)..(445): N at this position can be a, c, t, or g.
atcagttcgacatcacgacaaacgacgagcaccagacctccttgtatatcggttacttgagagggcggaagctacacaacagacacgatgccttccgaaagtggtcacagattatacgtcaagggacgtcacctgagctaccagcgctctcgtaacatcacccaccctggcaccagcctgatcaagatcgagggtgttgacagcacaaacgctgccaacttctacctcggcaagaaggtcgccttcgtctaccgtggccaganaggagatccgcggcaccaagatccgcgtgatctggggcaaggttacccgacctcacggtaactctggcgttgtccgcgccaagttcgccaagcctcttccctcaaagtctttcggtgcttccgttcgcgtcatgctgtacccctcgtcgatataaataggatttcggattggagttggtagntgagggcggttctcatttggttgcattggtcgaggcaaggataaagcatattgccttgctttgaggcttataactaaaaagacgtcaaattcccaacttcgaaaggttcttgggcatctgtgactcgacgtatgtggcagaaatttttgcgaaccgcaaaaatggagactcgaatcgaaacgaactgaggctgtggcagaccaattcttcttccttcttcttttttccccctccaa

SEQ ID NO: 552 - DNA, 453 bp, Artificial Sequence
  Synthetic
ccccgcttcccctcttggccgcgcctccgaaagccccaccggcggggagctcccagtctctctccggcggcagaagcggcggggactaccagatggtgaagggacgcaccgggaagggcgtgggggtctacgtccgcgggatcatcctcggatacaagaggtcgaagtcgaaccagtacgaaaacacgtcgctggtgcagatcgagggggtgaacaccaaggaggaggtggcgtggtactgcgggaagaggatggcgtacgtgtacaaggccaagaccaagagcggcggtacgaactaccgcggtatctggggcaaggtcacccgcccccatggcaactccggggtcgtccgcgccaagttcaagtccaacctgccccccggttccatggggcgcaaagtcagagtcttcatgtacccgagcaggatctaaagactcttgaagtgtggaggat

SEQ ID NO: 553 - DNA, 558 bp, Artificial Sequence
  Synthetic
cccacgcgtccgtaaaagagagtaagaagaggaagacgagagttacaaggattgaaaatgaagggacgtcaaggagagagagttagattgtatgttcgtggaacagtcctcggctacaagaggtccaagtcgaaccaatatcccaacacttctctcatccagattgaaggtgtgaacactcaagaggaggtcaattggtacaagggtaagcgtttggcttacatctacaaggcaaagacaaagaagaacggttctcactaccgttgcatttggggcaaagtcactaggcctcatggtaacagcggtgttgtccgttctaagttcacttcaaacctaccacccaagtcaatgggagctagagtcagagtcttcatgtaccctagcaacatatgaggaggatagatttcaagaagtatcggaaggaatcgccattatcatttctcaggagctgtagtttatctattcacttttgttctaaactctctgttggttttgattttatctttagacgaagtaaaacatttttcttcttgagataatattaatggaacttcagaa

SEQ ID NO: 554 - DNA, 333 bp, Artificial Sequence
  Synthetic
cccacgcgtccggtcaagggacgccaaggagaacgagtcatactctacgtgaggggaaccatcctcggatacaaaaggtcgaagtccaaccagtatccaaacacgtccctcgtccagatcgaaggagttaacactcaggaggaggtaaactggtacaagggaaagaggatggcttacatctacaaggctaagacaaagaagaacggtagccactaccgctgtatctggggaaaggttaccaggcctcacggtaacagcggtgttgtccgtgccaaattcacatccaaccttcctcccaagtccatgggaagcagagtgagagtcttcatgtat

SEQ ID NO: 555 - DNA, 648 bp, Artificial Sequence
  Synthetic
ggggtcgagggaaggagtaggagggagggagtcgaaggtaggagccatacctgtacctgcaccatgtcggccacccaaggagagcgcgtcaggttgtatgtccgagggagcatccttggctacaaaagggctaaatcaaaccagtaccccaacatgtcgctaattcaaatcgaaggtgtcaatacaactgaagaagcaaattggtatttcggtaagagaattgcatatgtatacaaagctagaacaaagaagaatggcaccctatatcgctgcacttggggaagagtgacccggtcccatggtaacagtggagttgttcgagccaagttcaaaacgaatttgccccccttgttcactgggcggaaaagtgcgagtatttatgtaccccagcaaaatttaagtttatctggtatcattgttaggagaactagttaatgaggtattaagtttactggaagagtagtggtatcttgtaggcatggattctctttctttttattgagttatattacatttgctgattttcctccctctcaatggtttaaggattgattgttacttgtttaggttgtcggcatcatccatgcttgaacattgctgaagaatcataggctttattttagatggtttttaaaaccagttccccta

SEQ ID NO: 556 - DNA, 413 bp, Artificial Sequence
  Synthetic
aactctactcgactctacgttaagggaaagcatatctcttaccagcgaagcaaacgagttgtgaaccccaacgtttctctcgtcaagattgagggcgtctccaaccccgacgaggccaagttctacgtcggaaagcgagttgcttacgtctaccgagccgagaaggagatccgaggctccaaggtccgagtcatgtggggcaagatttcccgaacccacggtaactccggtgtggtccgagctcgattccgacacaacctccccgccaagacctttggctcctccgtccgaatcatgctctacccttccaacatctaagtggtgtcgagaggtctgagtattcaaaataaccgtttctccaacggtcgcgcgtatagtgtattataggagaatgaacatgtgcaatagcaaaa

SEQ ID NO: 557 - DNA, 444 bp, Artificial Sequence
  Synthetic
  misc_feature (124)..(124): N at this position can be a, c, t, or g.
accagactctacgttaagggaaagcacctgtcttaccagcgaagcaagcgtgttgttaaccccaacgtgtctctcgtcaagattgagggtgtctccaaccccgaggaggccaagttctacctcnggaaagcgagtggcttacgtctaccgagccgacaaggagattcgaggcaccaaggtccgagtcatctggggcaatatcgtccgaactcacggtaactctggcgccgtccgagcccgattccgacacaacctgcctgccaagaccttcggctcttctctccgaatcatgctctacccttctaacatctaagcgaagataggtatgagttattgaggattgggcaacgcaaaaaaaggaaaacatgatggaaaaacaaaagaaaatgtcaatgatgactcccgtgcatcttgtataaagcaattaatttattggcgaatgtg

SEQ ID NO: 558 - DNA, 593 bp, Artificial Sequence
  Synthetic
gaccacgcgtcgcccatccctataccttgaatcgaaaatggtgaaaggacgtcaaggagagcgcatcagactctatgtcagaggaaccgttcttggatacaaaaggtcgaaatcgaaccagtacccaagcacttcgttgattcagattgagggagtgaacactaaggaggaagtggattggtacctcgggaagcgcatggcgtacatctacaaggctaagacaaagaagaataactctcattatcgctgcatttggggtaaggtttgtaggcctcatggaaacagcggcgttgtcagagctaagttcaagtccaacttgccgcctaagtctatgggatctaaggtcagggttttcatgtacccaagcaatatataagtgagggcatcacggagtagatgataagatcaaggtcattcgatgctttggaaggctttatgcctgatcaaggatgtctgatgattgatcttcatttttactagttaagaattaaattgtggcttttgcttagtggagttacattgttggtgttttgtttatcacttctgagtaatactgaagatccaaatctaattagatgtggctagttttactc

SEQ ID NO: 559 - DNA, 599 bp, Artificial Sequence
  Synthetic
gtggacttggagctcgcaaacttactaaaaagccaagtgaaagtctctatgagcagaagcctgaagaaccgcctattcaaatttcctcctccagcactgcaagtaatgcaacaactgttggttcatcattcacatctcgttttgagtacacagacaatatccaacctgctgagacgagttttggaggccctcgtgttcttaaccatgtagcccctccgaagtcctccaacttttttgcagattatgaaacggataatggtttcacaaagaagacaaattccaattcttcaaaaattcaaaaattggtgaagccgcttgaagtttgttttgatcctgtttcgagtgtcctggattgtcaacaagcaagagtcagttctattggagctttggattcttctgtagctattatttcattgatgaaattccccatgcgttctggaattgaggaaactgatgaagcaaggaagaagttttctaatgccaaatccatttcatctgctcaatactttggtgatcagtctaaaactgaaatggaagcctcagtctctctacagaaattctcgggttcaagtgcaatctctagcgctgacctatttggt

SEQ ID NO: 560 - DNA, 757 bp, Artificial Sequence
  Synthetic
  misc_feature (143)..(143): N at this position can be a, c, t, or g.
  misc_feature (386)..(386): N at this position can be a, c, t, or g.
tctttctcctctctctccctctcccaggctcaggggaggacatagcaaaggagaagaaggtcttttctcttggatatacgccatcatgttggtgtacagagatctcatatcaggtgatgagctactttcagactcttttcccntacactgaaatccagaatggcataatatgggaagtggaaggaaagtgggttgtccctggagcactcagtgttgacattggggccaacccttcagctgagggtgctgatgaagatgagggggttgatgacactgtgcagaaagttgttgacattgtggacacatttaggttgcaggagcaaccctcaatggacaagaaggcattcatttcttatgtgaaacgcttcattaaaaatttgaccccnaaaggtacttcctgatcgccaggaagagttcaagaagaatgtggagggagctgtgaaatggcttatgccaaagctgagtgacttgcaattctttgttggtgagagcatggctgatgacagtgcgatcgtttttgcctactacaaggaagggaaggccgacccaacattcctttatttccgtgattccctgaaggaagagaagtgctgagctcacttgcggccattttttgaacagaatgtttgcaaaggatttatataggttatgaaagatgcttatgctgtttggcatcttaggactcagatgttttttgcgttgcacttgagaacatctaaattgccttgggcaattgtgaatgttaataaccttgcta

SEQ ID NO: 561 - DNA, 824 bp, Artificial Sequence
  Synthetic
ttttctcctcctcttgtgcgtttttgttaagcgcaagttcttcagagggagaaacagagaaaaattctctccgataatgttggtttatcaggatcttctctccggtgatgagctcctttcggattcatttccctacactgaacttgaaaatggagtgctttgggaagtacaagggaagtgggttgttcagggagctgttgatgtgaacattggggctaatccatctgctgaaggcgcagatgaagatgaaggtgttgacgatcaagccatcaaggttgtcgatattgttgacactttcaggcttcaggagcaaccttcttttgacaagaagcagtttgttgcctacatgaagaaatatatcaagaacctaacacccaagttaggcgcagagcaggaagaagtttttaagaacaacattcaaggagcaaccaagtaccttttgtcaaagctcagtgaccttcaattctttgttggtgagagcatggctgatgatactggaatggtgtttgcctactacaaggatggcgccactgatccaacctttttgtacctcgcacatggactcaaggaggtcaagtgttaaaaagagtaggtacttgacctgttatgtgttctcggttttgatgcaacttttaccattaaatcagttgtctgaagttaaattttgtactgcaaacttatatagcagcttcgatatttgtgtgctttatatggattgattgaagaatcaacacatatacctaagatggtagcaaattctttttgatttgttacttttgtgactgttggacgttcttgttgttatgtactagcaattttgcatt

SEQ ID NO: 562 - DNA, 639 bp, Artificial Sequence
  Synthetic
gacaattctgtagatccagcgcggtgcgatccggccgccatgctcgtgtaccaggatttgctgtcgggcgacgagctcctgtcggattcgttcccgtacaaggagatccagaacggcgcgctgtgggaagtggaagggaaatgggtggtgaagggatccgtggacgtggacatcggcgccaatccgtcgcaggagggcggcgaggatgaggagggcgtggacgatcaggccgtcaaggtggtggacattgtcgataccttccgcctccaggagcaggcggcgttcgacaagaagactttcctggccgccatgaagaagttcatcaagaagctgtcggaggttctgcccgaggaggagcaggccgagttcaagaagaacatcgaggcggcggtcaagtggctgctctccaagctcagcgatttccagttcttcgtcggggagagcatgaaggatgatgcgacgctcgtctttgcgtactacaaggaaggcagttccgatcccacctttatctacttcaagcacgcgttgaaggaagtcaagtgctaatagtattgtcgttgtttgtccctctcaagatctagtatggttctgtatgctgctgcaacttctctgtcgttttaattccctctgtgatcaatc

SEQ ID NO: 563 - DNA, 641 bp, Artificial Sequence
  Synthetic
ctcccgcaaccttcgattttcgtttattcgcatccatcggagagagaaaacaatcaataagcgaccatgttggtgtaccaagatcttctcaccggtgatgagcttctgtctgactctttcccttacaaggagattgagaatggaatcctctgggaagtagaaggaaagtgggttactgtgggagctgtagatgttaacattggtgccaatccatctgctgaagaaggtggtgaggatgaaggtgttgatgactctactcaaaaggttgttgacattgtcgacaccttcagacttcaggagcaaccaacttatgacaagaagggattcatcgcttacattaagaaatacattaagcttttgacacccaagctcagcgaagaagatcaagctgtcttcaagaagggtattgagggagctaccaagtttttgctccccaggctcagtgacttccaattctttgttggggagggtatgcatgatgacagcactttggtctttgcttactacaaggagggttcaactaacccaacatttttgtacttcgctcatggtttgaaggaggtcaagtgctgagagagaagctctcgttgggttactgtggtcggtcgcagcgactctctaaggttatgtttctttatatt

SEQ ID NO: 564 - DNA, 873 bp, Artificial Sequence
  Synthetic
ccccccccccgctctctctccgtccgtccgcgccgctactccccccctcgccgagagagctctagggtttccgctgccgaattttttttttaattcggggggagagatttgaagaggcggcaccatgttggtctaccaggatctgcttaccggtgacgagctcctgtcggattcgttcccctacagagagatcgagaacggcatcctctgggaagtcgatggcaagtgggtcgttcaaggagctattgatgtggacattggtgccaacccatctgctgagggtggtggtgatgatgagggtgttgatgaccaagctgtgaaggtggtcgacattgtggacaccttccgtcttcaggagcaacctccttttgacaagaagcagtttgtgaccttcatgaagcgctacatcaagaacctctccgccaagctggatgcggaaaagcaagaggaattcaagaagaacattgagggtgccaccaagtacttgcttggaaagctcaaggaccttcagttctttgttggtgagagcatgcatgatgatggcggcttggtgtttgcctactacaaggacggagccaccgacccaaccttcctttacttctctcatgggctgaaggaggtcaagtgcgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatct

SEQ ID NO: 565 - DNA, 717 bp, Artificial Sequence
  Synthetic
agccttgctggtctcttcttgtcatcctcctactttttagagagagaaagcaaaagaatacgctaccaccatgttggtttatcaggatcttatctccggtgatgagctcctctcagattcatttccctacaaagaacttgagaatggatgtctttgggaggttcaagggaagtgggttgttcaaggtgctcttgatgtagacattggggcgaatccttctgccgagggtgctgatgaagatgaaggtgtggatgatcaagctgtcaaggttgtcgatattgttgacactttcagacttcaggagcaaccatcttttgacaagaaacaatttgttacatacatgaagagatacatcaagaacctgactcccaagctagaaggagaagcccaagaagcatttaaaaagaacattgaatcagcaactaagttcctcatgtcaaagctcaaggaccttcagttctttgttggcgagagcatgcatgacgatggtgccctggtgtttgcatactacaaggatggtgcaactgatcctacctttttgtaccttgcacctggcttgaaggaggtcaagtgctagatgtctgtttggagattttgagctacaagtttcaaatttgagatgttccatgtagttttaagtttttatctttttttttgcttatttatggtagtgtcttatgaacttgggtacttgttttaaccagtactttctgaact

SEQ ID NO: 566 - DNA, 1023 bp, Artificial Sequence
  Synthetic
  misc_feature (160)..(160): N at this position can be a, c, t, or g.
ggtttcaccacttacccacctgcatatctgagcccccaagcatcaggcaagaatctacttattggtactaacttcgcttctgccgctgctggctatgatgataaaactgccatcctcagccatgcaattccattgtcaatacagatgcaacattataagngaataccaagccaagctaacaaaagttgcaggcagccaaaaagctgcatcaatcctaaaggatgcgctctacatattaagtgcaggaagcagtgatttcttacagaattactacattaatccttatattaacaaactctatactcctgatcagtatggttcttatcttatcggcatcttcactagctttgtcaaggatttgcatgcccaaggagcaaggagaattggagtgacttcactaccaccattgggctgtcttcctgctgctagaacattgttcggatttcacgagagtggatgtgtctcaaaaatcaatacagatgcccaacaattcaacaaaaagataaattcagctgctacacaattacaaaaacaactcccaggccttaaaattgccatatttgacattttccagcccctatatgacctcgtcaaatctccatcaaaccacggattcacggaagcaaataaggggtgttgtggaacaggaacagtggagacgacgtcgttgttgtgcaacccaaagtcaccagggacttgtagcaatgcaactcaatatgtgttttgggatagtgtacatccatctgaagctgctaaccaagtcctagctgattcactcatcatccaaggcatcaaccttattggataattgaacagaatttaaagtattgttactcttatatttctctcgaatttaatgtataagtctttctcaaagttaccacgttcattttcttttgtttctggggtttcttgtttctgggagatgaaaacattgtcctgtattgcttaatattttccttttattaatgagagtaccatgtgttgtgttggaaacaaaatgtaataaggaagatttcaacc

SEQ ID NO: 567 - DNA, 637 bp, Artificial Sequence
  Synthetic
cccacgcgtccgctctacatttatcaagcaagtgtatgcggttggagcaaggaagatcggtgtgacatctctgcctccaacaggatgtcttcccgctgcaagaacccttttcggtttccatgaaaaaggctgtgtttcaagactcaacacagatgctcaaaactttaacaagaagcttaacgctgctgcttcaaagcttcagaagcaatattccgatcttaagattgttgtcttcgacatctactctccactttatgatcttgttcagaacccttccaaatccggattcacggaagcaaccaaaggatgttgtggaacaggaacagtcgagacaacttcactcttgtgcaacccgaaatcgtttgggacatgctccaatgctactcagtatgtgttctgggacagtgtgcatccttctgaagctgccaatgagattcttgccactgccctaattggacagggcttttctctcctcggttgatctcacgtatttttcttatattctcttttcaaatcgctgtttctatcacacattgagtcatacatttgtttttctttgaattatgtatcaaagcatcactgttttactaaaaatgtattgaaacttattacaagtactaaaccaagagttgagaac

SEQ ID NO: 568 - DNA, 536 bp, Artificial Sequence
  Synthetic
cttcaattctctcccttctctctcttctctttcttcttcttcttcctcgcgccttcttcaatctccggctttcgcttctccagttttgagccttaaacccaacgctgtcgagtccaagaacagagtctctctcagtgcttacagcttgaactctagccatggaagaattgtggtgaaggcggctgcttctggcgtggacggggctgagcctgagagcaatgaggaaccaaagactgttgttgctgctgttccagtggataaactaccgttggaatcgaaagaagctaaagagaaactgctcttggaattgaggctgaagatgaagctggccaaaaagattaggctacgcaggaaacgtctggttcgtaagcgtaagatgaggaagaagggtcgatggccaccttccaagatgaagaaaaacaagaatgtctaagtgactcaactgtttgctgcttttcgtattcgttttttgtaatgttctttttggtgttcaaagaccattaatgtacttcaaatgcaaccattgtttttggatt

SEQ ID NO: 569 - DNA, 457 bp, Artificial Sequence
  Synthetic
ggcgaaaatcaatggttgcatttgaagaacattaatggactttaaccaccaaaaagaacattacaaaaatccaatactaaacgcagcatacagattagtcactcacacattcttgttccatttaatcttgcaaggcggccatcgacccttcttcatcatcttacgcttacgaaccagacgtttcatgagtagcctaatctttatggccagacttcatcttcagcctcaattccaacatcagcttctctttaacttctttcaattccaacggtagtttatccactggaacagcaccaacaacaatctttggttactcattgctctcaggctcaatcccgtccacgccataaacagacgccttcaccacaattcttccatggttacagttcaagctgtaatcactgaaaaaaactctgtttttggactctacagcgttggctttaaggctcaaaactgg

SEQ ID NO: 570 - DNA, 449 bp, Artificial Sequence; identical to SEQ ID NO: 318
  Synthetic

SEQ ID NO: 571 - DNA, 594 bp, Artificial Sequence
  Synthetic
gtttccttggtggaagtgctgaccttgcatcatccaacatgacattgctgaaagccttggcgacttccaaaaggccacacctgaagaaagaaatcttaggtttggtgttagggagcacggaatgggagccatctgcaatggcattgcccttcacagccccggtcttatcccttactgtgcgacgttctttgtcttcaccgactacatgagaggtgccatgagaatctcagctttgtctgaagctggtgttatctatgttatgacccatgattccattggtcttggagaagatggaccaacccatcagcccattgagcacattgcaagtttccgtgctatgcccaacactcttatgttccgtcctgctgatggaaatgaaacagccggtgcatacaagatcgctgtcaccaagcgcaagacaccatctatcttagctctgtctaggcaaaagctgcctcatcttccaggtacatccatcgaaggagtggaaaagggtggatatacaatttctgacgactcttcaggcaacaaacccgatgtgatcttgattggaactggttctgagctagagattgctgcacaggctgcggaggt

What is claimed is:

1. An isolated nucleic acid of SEQ ID NO:47, wherein expression of said isolated nucleic acid in a plant results in a stunting phenotype of said plant.

2. A vector comprising the isolated nucleic acid of claim 1.

3. The vector of claim 2, wherein said isolated nucleic acid is operably linked to a plant promoter.

4. The vector of claim 2, wherein said isolated nucleic acid is in sense orientation.

5. A transfected plant comprising an isolated nucleic acid of SEQ ID NO:47, wherein expression of said isolated nucleic acid in a plant results in a stunting phenotype of said plant.

6. The plant of claim 5, further comprising a vector comprising said isolated nucleic acid sequence.

7. A leaf from said plant of claim 5.

* * * * *